United States Patent 7,745,391 (HUMAN THROMBOSPONDIN POLYPEPTIDE) - sequence listing, part 93

SEQ ID NO: 301715 - DNA, 167 bp, Homo sapiens
ggtctcctcgactcctgaggaaagcccaccgggcggggcgggaggtgaaaaggctggggaagtcagagccctctcccgcacactcagtccccctgcctggcgttcctgccgcagctctgacctggtgctgtcgccctggcatcttaataaaacctgcttatacttcc

SEQ ID NO: 301716 - DNA, 1438 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301717 - DNA, 1508 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcggcagctgagtctttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301718 - DNA, 1631 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301719 - DNA, 1099 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaatcgcggaggtgggtttcccagggcaaggctgatctgttgccgtattagtccgttttcacacagctataaagaatgcctgagactgggtgatgtataaagaaaagaagtttaactga

SEQ ID NO: 301720 - DNA, 1540 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgacgtgaaaaaacaaaaaaaaactgaaacatgatctcctttaacaaagggtcgagactgaagtcctaatcatcctgtggtgtggagagggatcaatctcgaaaaagcggaaacgcgcagcatgtgtacaatcaagacactcggggggggggggcgggacccaatgccccctttatgaaggggcccttaaatatagatgagccccgttttaaaaaacatgagcacggaaaaaccgcggctgccccaaatataatggtgtggaaaaaaaccctgtttgggcgtggggggaataatgaagagaccccgccaattcgcccttccacacaaatgtcacaggcccatggacaatacaacatattgtcgtgcttatatttttgaaaaaaccgggatatagctgatacacaggcgcattattaacccaaaggggccacttggcaatacactctataaaaaacaaaacaacccgacaggggggaagtgtggcccaacatgagacaaaattcctctattgaagcccgctccccccgggaagggggaaaaggcctctttagggctgggccc

SEQ ID NO: 301721 - DNA, 1769 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301722 - DNA, 1726 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggtggggagttggggtccccgaaggtgaggaccctctggggaggagggtgcttctctgagacactttcttttcctcacacctgttcctcgccagcagccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301723 - DNA, 1654 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggtggggagttggggtccccgaaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301724 - DNA, 1684 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaacctgtctcagtggagctgggtcatctcaggtggggagttggggtccccgaaggtgaggaccctctggggaggagggtgcttctctgagacactttcttttcctcacacctgttcctcgccagcagccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301725 - DNA, 1576 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301726 - DNA, 1603 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgagccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301727 - DNA, 1031 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcggcagctgagtctttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttcc

SEQ ID NO: 301728 - DNA, 1822 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaacctgtctcagtggagctgggtcatctcaggtggggagttggggtccccgaaggtgaggaccctctggggaggagggtgcttctctgagacactttcttttcctcacacctgttcctcgccagcagccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301729 - DNA, 1703 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggccttggctccttgaacttttggccgccatgtgcttcccgaaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301730 - DNA, 1571 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301731 - DNA, 1146 bp, Homo sapiens
ctcgaggatctctggcaaggtggaaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301732 - DNA, 1594 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggtggggagttggggtccccgaaggccttggctccttgaacttttggccgccatgtgcttcccgaaggtcctctctgatgacatgaagaagctgaaggcccgaatggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301733 - DNA, 1284 bp, Homo sapiens
ggaggcatccaagccccagggctccttgaggaaacaacaggggtgccagacgtggcccgggcccctggctgggcccagttcggggtgtgtgggagctgaggactcactgggcttgaggactgactgatgtggggtgcagaggaggcttgggcctggaaccgagtgctttgttcctaacagtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301734 - DNA, 1535 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggtggggagttggggtccccgaaggtgaggaccctctggggaggagggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301735 - DNA, 1211 bp, Homo sapiens
caagagtgtcaatcaagacgtaggacatgcctgctcctgaaggtttggagagaaaaggctgggggtaggactgggttcaaagagtgtcaatccagacgtaggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301736 - DNA, 1203 bp, Homo sapiens
  misc_feature (24)..(24): n is a, c, g, or t
gagctgggtcatctcaggccttgntcctttgaacttttggccgccatgtgcttcccgaagtcctctctgatgacatgaagaagctgaaggcccgaatggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301737 - DNA, 1795 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaacctgtctcagtggagctgggtcatctcaggtggggagttggggtccccgaaggtgaggaccctctggggaggagggtgcttctctgagacactttcttttcctcacacctgttcctcgccagcagccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301738 - DNA, 1140 bp, Homo sapiens
ggccacagtgggaagggggcaggcaggagcagcatgaaccccctgtgccctcctctccccaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301739 - DNA, 1544 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301740 - DNA, 1109 bp, Homo sapiens
  misc_feature (3)..(3): n is a, c, g, or t
  misc_feature (6)..(7): n is a, c, g, or t
  misc_feature (1043)..(1043): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcggcagctgagtctttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccaaaaaaaaaaanaaaagtgatgtattctagttgctaactatctactagtatgataattctttgggggggggcccgggc

SEQ ID NO: 301741 - DNA, 1030 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcggcagctgagtctttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcatccgaagcagttgccggaacaatagctaacattaaattggacaagatattttg

SEQ ID NO: 301742 - DNA, 1095 bp, Homo sapiens
gtactaaagctgcggactgattcaatagagggctactggtatactgttggcggcttataatgaggagcagcacccagaagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301743 - DNA, 1111 bp, Homo sapiens
gttgacgagctcgcaatcgtagagtcatagtcaatagctggtaggcggagcgggggacaggtggctggcttatgatgaggcgctgcgacccataagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgaaaggaaacagagacagacaaacgagaccaaccacacaaaccagagaacaagcccacacaaggagaaacagcacggagcaacacataagaaagcaccggcggcgggagcacaacacaacaacagacaggaggagcacaaacaagcagcagagcgcctaggccggcgaagacagccgcccgccaagtggtagacgccataaccagcgagccgcgagccgcaataagacagcgagcgagaacagaatcgctggcgcactagaagacagcaagagcgcgcggagacagacgaccaataaccaagcagaccagcggaacaaaacgaaagctgagacaaaaagagcacgcggcgacaagaaggagaacgaaatggcgagcgcgcgcgacgtaacagcggcaagagacacaaccgagcacggacagcacaaagagaccaccgacaagaaagcaacagggccgt

SEQ ID NO: 301744 - DNA, 868 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgagactcccgtaccagggggattactagagggcct

SEQ ID NO: 301745 - DNA, 1066 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgagccttggctccttgaacttttggccgccatgtgcttcccgaaggtcctctctgatgacatgaagaagctgaaggcccgaatggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttcc

SEQ ID NO: 301746 - DNA, 837 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctcgtgccaccaggtctgcagccgctgcagtcgacg

SEQ ID NO: 301747 - DNA, 1150 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccaccttcacgcggttccaccggggcacccctccactgaagcaccttcccacatcatgctggagcctgtgccccgatccatccttcaacgaccaacaccaacaagcctgcactgagagaaaaggccgcaacacgagcaggagcggaagacgcctggagaagagaccgtgtaaacaaccaaaagcaaaaacgcagaaagaggacaaagaaaataaggaaagagacgatgaggaaaggcaaaacgaacaccccaaatcgaacgaaaggagaagccggccaaaataaaggaggaagaacacacggacgagaaaagaagaagacaagaggaaaaagaagaaggagggagacgacaga

SEQ ID NO: 301748 - DNA, 757 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccatctgggccccgtccagtctctgggccccgtccagtctctgggccccg

SEQ ID NO: 301749 - DNA, 1370 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgacgtgaaaaaacaaaaaaaaactgaaacatgatctcctttaacaaagggtcgagactgaagtcctaatcatcctgtggtgtggagagggatcaatctcgaaaaagcggaaacgcgcagcatgtgtacaatcaagacactcggggggggggggcgggacccaatgccccctttatgaaggggcccttaaatatagatgagccccgttttaaaaaacatgagcacggaaaaaccgcggctgccccaaatataatggtgtggaaaaaaaccctgtttgggcgtggggggaataatgaagagaccccgccaattcgcccttccacacaaatgtcacaggcccatggacaatacaacatattgtcgtgcttatatttttgaaaaaaccgggatatagctgatacacaggcgcattattaacccaaaggggccacttggcaatacactctataaaaaacaaaacaacccgacaggggggaagtgtggcccaacatgagacaaaattcctctattgaagcccgctccccccgggaagggggaaaaggcctctttagggctgggccc

SEQ ID NO: 301750 - DNA, 1563 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgacgtgaaaaaacaaaaaaaaactgaaacatgatctcctttaacaaagggtcgagactgaagtcctaatcatcctgtggtgtggagagggatcaatctcgaaaaagcggaaacgcgcagcatgtgtacaatcaagacactcggggggggggggcgggacccaatgccccctttatgaaggggcccttaaatatagatgagccccgttttaaaaaacatgagcacggaaaaaccgcggctgccccaaatataatggtgtggaaaaaaaccctgtttgggcgtggggggaataatgaagagaccccgccaattcgcccttccacacaaatgtcacaggcccatggacaatacaacatattgtcgtgcttatatttttgaaaaaaccgggatatagctgatacacaggcgcattattaacccaaaggggccacttggcaatacactctataaaaaacaaaacaacccgacaggggggaagtgtggcccaacatgagacaaaattcctctattgaagcccgctccccccgggaagggggaaaaggcctctttagggctgggccc

SEQ ID NO: 301751 - DNA, 684 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacgggcctgtaatcccagatactcaggaggctgaggcaggagaatcacttgaacctgggaggcagaggttgcagtgagctgagatcacgccattg

SEQ ID NO: 301752 - DNA, 809 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttcc

SEQ ID NO: 301753 - DNA, 1216 bp, Homo sapiens
ggaggcatccaagccccagggctccttgaggaaacaacaggggtgccagacgtggcccgggcccctggctgggcccagttcggggtgtgtgggagctgaggactcactgggcttgaggactgactgatgtggggtgcagaggaggcttgggcctggaaccgagtgctttgttcctaacagtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgacgtgaaaaaacaaaaaaaaactgaaacatgatctcctttaacaaagggtcgagactgaagtcctaatcatcctgtggtgtggagagggatcaatctcgaaaaagcggaaacgcgcagcatgtgtacaatcaagacactcggggggggggggcgggacccaatgccccctttatgaaggggcccttaaatatagatgagccccgttttaaaaaacatgagcacggaaaaaccgcggctgccccaaatataatggtgtggaaaaaaaccctgtttgggcgtggggggaataatgaagagaccccgccaattcgcccttccacacaaatgtcacaggcccatggacaatacaacatattgtcgtgcttatatttttgaaaaaaccgggatatagctgatacacaggcgcattattaacccaaaggggccacttggcaatacactctataaaaaacaaaacaacccgacaggggggaagtgtggcccaacatgagacaaaattcctctattgaagcccgctccccccgggaagggggaaaaggcctctttagggctgggccc

SEQ ID NO: 301754 - DNA, 1078 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggcaataatacccaaaatctgattggtcatatttttccaaagagtaatgcagtctgaagtattaaatgtattttcgtgtcttccttataagggggattctccaagttgtaaatttaaacgagtaaatatcacatttgtcattaacacagtatacttgcagtgtcctcagatttatttgggactattttgatgccaaggtgatatagagacttgactgaacattatttcttctattagaattggaaatggtgtattttcctaatgaggggagtaccttttaaatgaaggtacctttactttgagggaatgcggtactcattga

SEQ ID NO: 301755 - DNA, 453 bp, Homo sapiens
agaaaaaccttacatgaaaatacaaagagccagaatagtcaagacactctcaaagaagaaaaataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgctaca

SEQ ID NO: 301756 - DNA, 3146 bp, Homo sapiens
ttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgattttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtgatagtcttgatattatccataatgtgattgcaaatatcttctctaactctggcttgactgtttatggtgtccttttttttggggggggttttttgagacagggtcttgctctgtcacccaggctggagtgttgtggcacagtcttggcttattgcagcctcaattcctgggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccggctactcgggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgctaca

SEQ ID NO: 301757 - DNA, 3092 bp, Homo sapiens
ttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgattttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtgatagtcttgatattatccataatgtgattgcaaatatcttctctaactctggcttgactgtttatggtgtccttttttttggggggggttttttgagacagggtcttgctctgtcacccaggctggagtgttgtggcacagtcttggcttattgcagcctcaattcctgggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccggctactcgggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaaaatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgctaca

SEQ ID NO: 301758 - DNA, 3608 bp, Homo sapiens
cgtgggtttcatgtactcagccagcatttacttgccagtcaaggtctaggatggctacctgtcctctgcaggagccccaagcctattcattaatttcatttacaattttatagtcataattatttctttgtataatagcattctgagattttccaaaatttcccactgtttttgttttacagtgggcagaattcactttgctctaacttgactccaagatgacacaatttcccagttttttttttaacggctaggggatgggggtatgcggaacagaacacagtggtctagctaaccgatttccgctagacgtccagctatctttcaaaatattttgtttctgcacggcaacttcagccgctaatggccccgccccatgggaccgggcggcgtgggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggacaaaaatatttaattgctcagtaaactgcttaacttcaaagatagttattgaccttataaataaatatttcaaaattttgattcggaagactaagtctggacgtagacattataatgctatcaaagaagtttgatctctgttttgactaaactagaggaaaaatgattggatgtgtttattcttttctaagcagaatggtttaactttgtactctttgaaaaataatgctgatttataaatctctgcctataacagaatggaaaccttatgaatgaattgtgtttctctgtcctgagctggagaagggaatgagcaggctgacacgttgcacagccccaggtggcgccattctctcacgcaaggatggggctgcagggtgagcagcgtgggctgcagtgtgtcagtcccaggagtgagggagtggcaagcaccacagattaccacgtatgtgtggaagacattcgtactcttatctttactataaataaattcataaaagttaacaaaggggtacacagtatggtctttggaaatataataaaacatcaactaacttggactaattgtgaggaagagcagaacaaattagtagaaagaggttataagacaattgagttagcttcatgtgtattattgcagcttgatcatttatataaatatttgtctagtacaatgcttgacatacagcattgtgttatgcccattggggacacagaggtgaacaagacaaggaatgccatcagggaattcaccttttattaggaaaatataaaatatgtatgtatgtgcagataatttgcttgaactaaactgactagttctgctaaataagattttaaactaattcatatgtaaaaagtgattaggaagaacttgaagtatcatttgatgcttaataactattgagtagttttttttttttttttttggtggggggagcgggggacagggtcttactctgtcactcaggccagagtacaatagtatgatctcggctcactgcaacttctgcctcccagtttcaagggattctcgtgcctcagcctcccaggtagctggtactacaggcacggaccaccacgcctggctaatttttgtattttttctagggacagggttttaccacgttgcccaggctggtcttgaacttttgagctcgagtgatccacccacctcagcctcccaaaatgctgggattacagatgtgagccaccgtgcttggccataactattgaatgctttctatgtggagagtgcttgtcttaattttctgttgctataatagaataacacagactgggtaatttataaagaaaagagatttatttggatcatggttctggaggctgggaggtccaagagcatggtaccagcatctgcttggcatctggtgacagctttcttgctgcatcattacatggtggaagggcaagagaatgcgagtgagagcaagagggcaaaatgattatccttttatcaggagcccacttctgacataactaacccacacctgagataacggcattaatccattcatgaggtctctgctcttaaaggagatcacctcttaaaggacccacctttcaatgccattacactggcaatttaatttcaagatgagttttggaggggacattcaaaccatagcagtgctataattttaaagtacttcaaagccaatttattctcttaattagcttcattattcttgtctttgtgtgtggattacctaaactctccttccagagctactttaatgattatattcaaccaaagcactctaaaatttagagtataaattgtcttatatttcaaattagaaaagttcaaatgaagtttaattgtgttattttataaaaccttctaaaattattaaatggaggatataatctataaatggtt

SEQ ID NO: 301759 - DNA, 2208 bp, Homo sapiens
cgtgggtttcatgtactcagccagcatttacttgccagtcaaggtctaggatggctacctgtcctctgcaggagccccaagcctattcattaatttcatttacaattttatagtcataattatttctttgtataatagcattctgagattttccaaaatttcccactgtttttgttttacagtgggcagaattcactttgctctaacttgactccaagatgacacaatttcccagttttttttttaacggctaggggatgggggtatgcggaacagaacacagtggtctagctaaccgatttccgctagacgtccagctatctttcaaaatattttgtttctgcacggcaacttcagccgctaatggccccgccccatgggaccgggcggcgtgggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggacaaaaatatttaattgctcagtaaactgcttaacttcaaagatagttattgaccttataaataaatatttcaaaattttgattcggaagactaagtctggacgtagacattataatgctatcaaagaagtttgatctctgttttgactaaactagaggaaaaatgattggatgtgtttattcttttctaagcagaatggtttaactttgtactctttgaaaaataatgctgatttataaatctctgcctataacagaatggaaaccttatgaatgaattgtgtttctctgtcctgagctggagaagggaatgagcaggctgacacgttgcacagccccaggtggcgccattctctcacgcaaggatggggctgcagggtgagcagcgtgggctgcagtgtgtcagtcccaggagtgagggagtggcaagcaccacagattaccacgtatgtgtggaagacattcgtactcttatctttactataaataaattcataaaagtta

SEQ ID NO: 301760 - DNA, 3555 bp, Homo sapiens
cgtgggtttcatgtactcagccagcatttacttgccagtcaaggtctaggatggctacctgtcctctgcaggagccccaagcctattcattaatttcatttacaattttatagtcataattatttctttgtataatagcattctgagattttccaaaatttcccactgtttttgttttacagtgggcagaattcactttgctctaacttgactccaagatgacacaatttcccagttttttttttaacggctaggggatgggggtatgcggaacagaacacagtggtctagctaaccgatttccgctagacgtccagctatctttcaaaatattttgtttctgcacggcaacttcagccgctaatggccccgccccatgggaccgggcggcgtgggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggacaaaaatatttaattgctcagtaaactgcttaacttcaaagatagttattgaccttataaataaatatttcaaaattttgattcggaagactaagtctggacgtagacattataatgctatcaaagaagtttgatctctgttttgactaaactagaggaaaaatgattggatgtgtttattcttttctaagcagaatggtttaactttgtactctttgaaaaataatgctgatttataaatctctgcctataacagaatggaaaccttatgaatgaattgtgtttctctgtcctgagctggagaagggaatgagcaggctgacacgttgcacagccccaggtggcgccattctctcacgcaaggatggggctgcagggtgagcagcgtgggctgcagtgtgtcagtcccaggagtgagggagtggcaagcaccacagattaccacgtatgtgtggaagacattcgtactcttatctttactataaataaattcataaaagttaacaaaggggtacacagtatggtctttggaaatataataaaacatcaactaacttggactaattgtgaggaagagcagaacaaattagtagaaagaggttataagacaattgagttagcttcatgtgtattattgcagcttgatcatttatataaatatttgtctagtacaatgcttgacatacagcattgtgttatgcccattggggacacagaggtgaacaagacaaggaatgccatcagggaattcaccttttattaggaaaatataaaatatgtatgtatgtgcagataatttgcttgaactaaactgactagttctgctaaataagattttaaactaattcatatgtaaaaagtgattaggaagaacttgaagtatcatttgatgcttaataactattgagtagttttttttttttttttttggtggggggagcgggggacagggtcttactctgtcactcaggccagagtacaatagtatgatctcggctcactgcaacttctgcctcccagtttcaagggattctcgtgcctcagcctcccaggtagctggtactacaggcacggaccaccacgcctggctaatttttgtattttttctagggacagggttttaccacgttgcccaggctggtcttgaacttttgagctcgagtgatccacccacctcagcctcccaaaatgctgggattacagatgtgagccaccgtgcttggccataactattgaatgctttctatgtggagagtgcttgtcttaattttctgttgctataatagaataacacagactgggtaatttataaagaaaagagatttatttggatcatggttctggaggctgggaggtccaagagcatggtaccagcatctgcttggcatctggtgacagctttcttgctgcatcattacatggtggaagggcaagagaatgcgagtgagagcaagagggctgagataacggcattaatccattcatgaggtctctgctcttaaaggagatcacctcttaaaggacccacctttcaatgccattacactggcaatttaatttcaagatgagttttggaggggacattcaaaccatagcagtgctataattttaaagtacttcaaagccaatttattctcttaattagcttcattattcttgtctttgtgtgtggattacctaaactctccttccagagctactttaatgattatattcaaccaaagcactctaaaatttagagtataaattgtcttatatttcaaattagaaaagttcaaatgaagtttaattgtgttattttataaaaccttctaaaattattaaatggaggatataatctataaatggtt

SEQ ID NO: 301761 - DNA, 1784 bp, Homo sapiens
cgtgggtttcatgtactcagccagcatttacttgccagtcaaggtctaggatggctacctgtcctctgcaggagccccaagcctattcattaatttcatttacaattttatagtcataattatttctttgtataatagcattctgagattttccaaaatttcccactgtttttgttttacagtgggcagaattcactttgctctaacttgactccaagatgacacaatttcccagttttttttttaacggctaggggatgggggtatgcggaacagaacacagtggtctagctaaccgatttccgctagacgtccagctatctttcaaaatattttgtttctgcacggcaacttcagccgctaatggccccgccccatgggaccgggcggcgtgggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggacaaaaatatttaattgctcagtaaactgcttaacttcaaagatagttattgaccttataaataaatatttcaaaatttt

SEQ ID NO: 301762 - DNA, 3548 bp, Homo sapiens
cgtgggtttcatgtactcagccagcatttacttgccagtcaaggtctaggatggctacctgtcctctgcaggagccccaagcctattcattaatttcatttacaattttatagtcataattatttctttgtataatagcattctgagattttccaaaatttcccactgtttttgttttacagtgggcagaattcactttgctctaacttgactccaagatgacacaatttcccagttttttttttaacggctaggggatgggggtatgcggaacagaacacagtggtctagctaaccgatttccgctagacgtccagctatctttcaaaatattttgtttctgcacggcaacttcagccgctaatggccccgccccatgggaccgggcggcgtgggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgaccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggacaaaaatatttaattgctcagtaaactgcttaacttcaaagatagttattgaccttataaataaatatttcaaaattttgattcggaagactaagtctggacgtagacattataatgctatcaaagaagtttgatctctgttttgactaaactagaggaaaaatgattggatgtgtttattcttttctaagcagaatggtttaactttgtactctttgaaaaataatgctgatttataaatctctgcctataacagaatggaaaccttatgaatgaattgtgtttctctgtcctgagctggagaagggaatgagcaggctgacacgttgcacagccccaggtggcgccattctctcacgcaaggatggggctgcagggtgagcagcgtgggctgcagtgtgtcagtcccaggagtgagggagtggcaagcaccacagattaccacgtatgtgtggaagacattcgtactcttatctttactataaataaattcataaaagttaacaaaggggtacacagtatggtctttggaaatataataaaacatcaactaacttggactaattgtgaggaagagcagaacaaattagtagaaagaggttataagacaattgagttagcttcatgtgtattattgcagcttgatcatttatataaatatttgtctagtacaatgcttgacatacagcattgtgttatgcccattggggacacagaggtgaacaagacaaggaatgccatcagggaattcaccttttattaggaaaatataaaatatgtatgtatgtgcagataatttgcttgaactaaactgactagttctgctaaataagattttaaactaattcatatgtaaaaagtgattaggaagaacttgaagtatcatttgatgcttaataactattgagtagttttttttttttttttttggtggggggagcgggggacagggtcttactctgtcactcaggccagagtacaatagtatgatctcggctcactgcaacttctgcctcccagtttcaagggattctcgtgcctcagcctcccaggtagctggtactacaggcacggaccaccacgcctggctaatttttgtattttttctagggacagggttttaccacgttgcccaggctggtcttgaacttttgagctcgagtgatccacccacctcagcctcccaaaatgctgggattacagatgtgagccaccgtgcttggccataactattgaatgctttctatgtggagagtgcttgtcttaattttctgttgctataatagaataacacagactgggtaatttataaagaaaagagatttatttggatcatggttctggaggctgggaggtccaagagcatggtaccagcatctgcttggcatctggtgacagctttcttgctgcatcattacatggtggaagggcaagagaatgcgagtgagagcaagagggcaaaatgattatccttttatcaggagcccacttctgacataactaacccacacctgagataacggcattaatccattcatgaggtctctgctcttaaaggagatcacctcttaaaggacccacctttcaatgccattacactggcaatttaatttcaagatgagttttggaggggacattcaaaccatagcagtgctataattttaaagtacttcaaagccaatttattctcttaattagcttcattattcttgtctttgtgtgtggattacctaaactctccttccagagctactttaatgattatattcaaccaaagcactctaaaatttagagtataaattgtcttatatttcaaattagaaaagttcaaatgaagtttaattgtgttattttataaaaccttctaaaattattaaatggaggatataatctataaatggtt

SEQ ID NO: 301763 - DNA, 2651 bp, Homo sapiens
agttgctctgatactgagtcactgatgggagctaagccagacacggcatcaacggtaggtcgatgccgtggatcattgattctgactaacacatcgtaatgatccaagtatcgacttgttcagatgctgctcctgcaacattcagctcgagctgaatgccacgaccaggtccaattgcactgatgcggctacatgaactccttcacacgtatagacaaactagagagtcatttacagtggtcatattcaccatagtattccataatgtagtcactgtatcttcaaagtgactgtcaacactggagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggacaaaaatatttaattgctcagtaaactgcttaacttcaaagatagttattgaccttataaataaatatttcaaaattttgattcggaagactaagtctggacgtagacattataatgctatcaaagaagtttgatctctgttttgactaaactagaggaaaaatgattggatgtgtttattcttttctaagcagaatggtttaactttgtactctttgaaaaataatgctgatttataaatctctgcctataacagaatggaaaccttatgaatgaattgtgtttctctgtcctgagctggagaagggaatgagcaggctgacacgttgcacagccccaggtggcgccattctctcacgcaaggatggggctgcagggtgagcagcgtgggctgcagtgtgtcagtcccaggagtgagggagtggcaagcaccacagattaccacgtatgtgtggaagacattcgtactcttatctttactataaataaattcataaaagttaacaaaggggtacacagtatggtctttggaaatataataaaacatcaactaacttggactaattgtgaggaagagcagaacaaattagtagaaagaggttataagacaattgagttagcttcatgtgtattattgcagcttgatcatttatataaatatttgtctagtacaatgcttgacatacagcattgtgttatgcccattggggacacagaggtgaacaagacaaggaatgccatcagggaattcaccttttattaggaaaatataaaatatgtatgtatgtgcagataatttgcttgaactaaactgactagttctgctaaataagattttaaactaattcatatgtaaaaagtgattaggaagaacttgaagtatcatttgatgcttaataactattgagtagttttttttttttttttttggtggggggagcgggggacagggtcttactctgtcactcaggccagagtacaatagtatgatctcggctcactgcaacttctgcctcccagtttcaagggattctcgtgcctcagcctcccaggtagctggtactacaggcacggaccaccacgcctggctaatttttgtattttttctagggacagggttttaccacgttgcccaggctggtcttgaacttttgagctcgagtgatccacccacctcagcctcccaaaatgctgggattacagatgtgagccaccgtgcttggccataactattgaatgctttctatgtggagagtgcttgtcttaattttctgttgctataatagaataacacagactgggtaatttataaagaaaagagatttatttggatcatggttctggaggctgggaggtccaagagcatggtaccagcatctgcttggcatctggtgacagctttcttgctgcatcattacatggtggaagggcaagagaatgcgagtgagagcaagagggcaaaatgattatccttttatcaggagcccacttctgacataactaacccacacctgagataacggcattaatccattcatgaggtctctgctcttaaaggagatcacctcttaaaggacccacctttcaatgccattacactggcaatttaatttcaagatgagttttggaggggacattcaaaccatagcagtgctataattttaaagtacttcaaagccaatttattctcttaattagcttcattattcttgtctttgtgtgtggattacctaaactctccttccagagctactttaatgattatattcaaccaaagcactctaaaatttagagtataaattgtcttatatttcaaattagaaaagttcaaatgaagtttaattgtgttattttataaaaccttctaaaattattaaatggaggatataatctataaatggtt

SEQ ID NO: 301764 - DNA, 1723 bp, Homo sapiens
cgtgggtttcatgtactcagccagcatttacttgccagtcaaggtctaggatggctacctgtcctctgcaggagccccaagcctattcattaatttcatttacaattttatagtcataattatttctttgtataatagcattctgagattttccaaaatttcccactgtttttgttttacagtgggcagaattcactttgctctaacttgactccaagatgacacaatttcccagttttttttttaacggctaggggatgggggtatgcggaacagaacacagtggtctagctaaccgatttccgctagacgtccagctatctttcaaaatattttgtttctgcacggcaacttcagccgctaatggccccgccccatgggaccgggcggcgtgggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatcctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggacaaaaatatttaattgctcagtaaactgcttaacttcaaagatagttattgaccttataaataaatatttcaaaatttt

SEQ ID NO: 301765 - DNA, 1199 bp, Homo sapiens
cgtgggtttcatgtactcagccagcatttacttgccagtcaaggtctaggatggctacctgtcctctgcaggagccccaagcctattcattaatttcatttacaattttatagtcataattatttctttgtataatagcattctgagattttccaaaatttcccactgtttttgttttacagtgggcagaattcactttgctctaacttgactccaagatgacacaatttcccagttttttttttaacggctaggggatgggggtatgcggaacagaacacagtggtctagctaaccgatttccgctagacgtccagctatctttcaaaatattttgtttctgcacggcaacttcagccgctaatggccccgccccatgggaccgggcggcgtgggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttgaacaacctctgagctgcctcactctgggcacactgcctatgggatagctgtgctccacaaggagtcctacttctgctgctgctgtatgctgctgcttcaatgaaagttgctatttaacacgaccgacccgccctgaatcgtttcctgggcaaagctaagaaccttcctgggctaagccccaattttggggcctgtctaccctgcatcaattctatatgaattttagaatagtttttttataattctgtgaaaaatgat

SEQ ID NO: 301766 - DNA, 763 bp, Homo sapiens
aaagtgtagctttcttttatagtctgtgtggttttaattatctaggaattgattaatcattttcttggccttgctaataacctcagttctccaccattgtgccttctgattgtttccttgcttgtcagctctttgaccaaaaagtagtggtctggtgaaacagttaatagataataggaaccaaaggctaaaatgaagctttggtacaccaagtttattgtattcatatttaccttttgttattctctagttgatagggttggttatatctgttttgacataaaggaaatttaaaaggttaataagttccctgactgctttgggtaagaaaatataaagactatcttaaacaactgcattgccttgtgaatatatatacgtaatactaaaccataccttcccccttttccatacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatag

SEQ ID NO: 301767 - DNA, 481 bp, Homo sapiens
gggtatgcggaacagaacacagtggtctagctaaccgatttccgctagacgtccagctatctttcaaaatattttgtttctgcacggcaacttcagccgctaaaaaagcatccagcttacaacggaacctggagggttggtaaaggccccctgcgctggccccgccccatgggaccgggcggcgtgggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcc

SEQ ID NO: 301768 - DNA, 1894 bp, Homo sapiens
  misc_feature (786)..(786): n is a, c, g, or t
  misc_feature (789)..(789): n is a, c, g, or t
  misc_feature (794)..(795): n is a, c, g, or t
  misc_feature (816)..(816): n is a, c, g, or t
  misc_feature (818)..(819): n is a, c, g, or t
  misc_feature (823)..(823): n is a, c, g, or t
  misc_feature (836)..(836): n is a, c, g, or t
  misc_feature (840)..(840): n is a, c, g, or t
  misc_feature (855)..(855): n is a, c, g, or t
  misc_feature (858)..(858): n is a, c, g, or t
tctaagatgacctctactgggatgacaggggtgagttgacaaagcttcgcacatcattcatcctccagcagtctcacccaggcatgatttcatgggagtggcagaggagcgagggtgcttttgcagaaaggtacaagagctttttcaggtcttggcttgcatcacatccttatccaatgaaccaaagcaagtgacatggctgagagtccctgtaggaggtgcagggagtgtggggactctacaaggtgacatgtcaaaaggcaggaatacagggaacagtaaagcactgggactgttattacaaccagtaacttgtttctagaagtctgcttgatgaaaccttcaagccacatggaggagtcctcaaagatgtgcttgagatattcatataatttcttctgctctaagaaccatgaggtgaacttgacctcaaagtgagaccttgacattggggcatttaagtcagtatctgtgtcttccaccccacacctgatccctgacccaaagtctccacagagactaatagaacccatcattagaggaatggggacctactgcactcttcgtagtgccagggttggatgtgttgcttctcctaagctgtttccctgcagggcagcacagcactgcctcggaactcaaggttagcctcgtgcctctcggccgaatctgttactcaaggattcctgaaaggcagtctgcctagaaatggaggtcaaatgaaagaaaggcctaagggttttttttgtcttgttttgttttgggttttttttgagacagagtctngcnctgtnnccaggctggagtgcagtggcncnntctnggctcactgcaanctcngcctcccaggttcangcnattctcctgcctcggcctcccaaggtgctgggactacaggcatgagccactgtgcctgaccttacagcagtattttttaaaaatcaaaattaatgcaaaaatccatgatgaggccaggcttggtggctcatgcctgtaattccagcactttgggaggatcccttgagcccaggtgtttgagaccagtttgggtaacataggaagagcttgtctctacaaacaaaaatttaaaaacaatgagctgggcatggaactcacacctctagccccagctactcgggctgaggtgggaggatggcttgagcccaggagttcaaggatgcagtgtgctttgattgcactactgcgcttcaccctgggcaacagagtgagaccccatctctttaaaaaaaaaaaaaaatccatgatgaacaaaacaagtatttgtttgagacggggtctcgctctgtcgcccaggctggagtgcagtggtgccatctcagctcactgcaacctccgccttctgggttcaagcgactctcctgcctcagcctcccgagtagctgggattacaggagcctggcactatgcctggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301769 - DNA, 1745 bp, Homo sapiens
  misc_feature (1620)..(1620): n is a, c, g, or t
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaatcctgactccgccacttttcccactgtatgatcttgggcaagtcacttcacctctctgtgccttggtttcctcatttataaaatgtggataacaggccgggcgcagtggctcacgcctgtaatcccagcactttgggaggccgaggcaggtggatcacaagatcaggagattgagaccatcctggctaacatggtgaaaccccatctctgctgaaaatacaaaaaattagccgggtgtggtggtgggcacctgcagtcccagctacttgggaggctgaggcnggagaatggcgtgaaactgggaggcagagcttgcagtgagccgagatagcgccactgcactccagcctgggcaacagagcgagactccgtctcaaaaataaatataattaattaattatttaatt

SEQ ID NO: 301770 - DNA, 583 bp, Homo sapiens
  misc_feature (120)..(120): n is a, c, g, or t
gagatcaagtatcactcgttacccaggctggaatgtagaggcgagatctcagctcactgaaacctgtgcctccccggttcaagcgattctcctgccacagctacttgggaggctgaggcnggagaatggcgtgaaactgggaggcagagcttgcagtgagccgagatagcgccactgcactccagcctgggcaacagagcgagactccgtctcaaaaataaatataattaattaattatttaattaaaaaaataaaaaataaatgtggataatactagtacctccctcttaaggtcagggctggagctagggtgacatctccagggcagaattttaagaggacaccaaaaaagctcagcaaccaagataaaaaatattttaaagcaatattttgttttgggttttttttttttgagatcaagtatcactcgttacccaggctggaatgtagaggcgagatctcagctcactgaaacctgtgcctccccggttcaagcgattctcctgccacagcctcctgagtagctgggattacaggcatgcgccaccatgcccagctaatttttctatttttagtagagac

SEQ ID NO: 301771 - DNA, 2217 bp, Homo sapiens
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctcggcctcccaaggtgctgggactacaggcatgagccactgtgcctgaccttacagcagtattttttaaaaatcaaaattaatgcaaaaatccatgatgaggccaggcttggtggctcatgcctgtaattccagcactttgggaggatcccttgagcccaggtgtttgagaccagtttgggtaacataggaagagcttgtctctacaaacaaaaatttaaaaacaatgagctgggcatggaactcacacctctagccccagctactcgggctgaggtgggaggatggcttgagcccaggagttcaaggatgcagtgtgctttgattgcactactgcgcttcaccctgggcaacagagtgagaccccatctctttaaaaaaaaaaaaaaatccatgatgaacaaaacaagtatttgtttgagacggggtctcgctctgtcgcccaggctggagtgcagtggtgccatctcagctcactgcaacctccgccttctgggttcaagcgactctcctgcctcagcctcccgagtagctgggattacaggagcctggcactatgcctggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301772 - DNA, 2378 bp, Homo sapiens
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaatcctgactccgccactcggcctcccaaggtgctgggactacaggcatgagccactgtgcctgaccttacagcagtattttttaaaaatcaaaattaatgcaaaaatccatgatgaggccaggcttggtggctcatgcctgtaattccagcactttgggaggatcccttgagcccaggtgtttgagaccagtttgggtaacataggaagagcttgtctctacaaacaaaaatttaaaaacaatgagctgggcatggaactcacacctctagccccagctactcgggctgaggtgggaggatggcttgagcccaggagttcaaggatgcagtgtgctttgattgcactactgcgcttcaccctgggcaacagagtgagaccccatctctttaaaaaaaaaaaaaaatccatgatgaacaaaacaagtatttgtttgagacggggtctcgctctgtcgcccaggctggagtgcagtggtgccatctcagctcactgcaacctccgccttctgggttcaagcgactctcctgcctcagcctcccgagtagctgggattacaggagcctggcactatgcctggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301773 - DNA, 2120 bp, Homo sapiens
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaatcctgactccgccactcggcctcccaaggtgctgggactacaggcatgagccactgtgcctgaccttacagcagtattttttaaaaatcaaaattaatgcaaaaatccatgatgaggccaggcttggtggctcatgcctgtaattccagcactttgggaggatcccttgagcccaggtgtttgagaccagtttgggtaacataggaagagcttgtctctacaaacaaaaatttaaaaacaatgagctgggcatggaactcacacctctagccccagcctcccgagtagctgggattacaggagcctggcactatgcctggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301774 - DNA, 2419 bp, Homo sapiens
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctagacgtgaaacggagctatgcgagcattgggaagagcataccaggcagagggaactgccactgcgagggcccctgggcgggactgtgctcggtaagcctttggcaatccacgcccagactaggagcctgcacccctaaccaatggaccaccctgtctgtttgcccctccccggggccttctcctggtgggtggggcccccgcaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctcggcctcccaaggtgctgggactacaggcatgagccactgtgcctgaccttacagcagtattttttaaaaatcaaaattaatgcaaaaatccatgatgaggccaggcttggtggctcatgcctgtaattccagcactttgggaggatcccttgagcccaggtgtttgagaccagtttgggtaacataggaagagcttgtctctacaaacaaaaatttaaaaacaatgagctgggcatggaactcacacctctagccccagctactcgggctgaggtgggaggatggcttgagcccaggagttcaaggatgcagtgtgctttgattgcactactgcgcttcaccctgggcaacagagtgagaccccatctctttaaaaaaaaaaaaaaatccatgatgaacaaaacaagtatttgtttgagacggggtctcgctctgtcgcccaggctggagtgcagtggtgccatctcagctcactgcaacctccgccttctgggttcaagcgactctcctgcctcagcctcccgagtagctgggattacaggagcctggcactatgcctggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301775 - DNA, 1607 bp, Homo sapiens
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagcctcccgagtagctgggattacaggagcctggcactatgcctggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301776 - DNA, 2009 bp, Homo sapiens
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaatcctgactccgccacttttcccactgtatgatcttgggcaagtcacttcacctctctgtgccttggtttcctcatttataaaatgtggataacaggccgggcgcagtggctcacgcctgtaatcccagcactttgggaggccgaggcaggtggatcacaagatcaggagattgagaccatcctggctaacatggtgaaaccccatctggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301777 - DNA, 2477 bp, Homo sapiens
agcacctagagccaggctgcccagattcaaatcctgactccgccacttttcccactgtatgatcttgggcaagtcacttcacctctctgtgccttggtttcctcatttataaaatgtggataacaggccgggcgcagtggctcacgcctgtagtcccagcactttgggaggccgaggcaggtggatcacaagatcaggagattgagaccatcctggctaacatggtgaaacccatctctgctaaaaataaaaaaattggccgggtgtggtggtgggcacctgcggtctccgcctctcgagtagctgggactacaggtgcccgccaccacgcccggctaattttttgaacttttagtagagatggggtttcaccgtgttagccaggatggtctcgatctcctgacctcgtgatccatctgcctgggcctcccaaagtgctgggattacaggcgtgagccaccacgcccagcccaaatattttcaatccacatggttgagtccatggatggagaacccatagaaaaggggggctgcctgtacacatgaggtgttagaaggtgataaatgctaaggacagagagcaggaaactgaaagtgtggggattgctatgcaaaactgatatatcagggaaggcttcaccgagaaggtgtcctttaaacagacgtgaaacggagctatgcgagcattgggaagagcataccaggcagagggaactgccactgcgagggcccctgggcgggactgtgctcggtaagcctttggcaatccacgcccagactaggagcctgcacccctaaccaatggaccaccctgtctgtttgcccctccccggggccttctcctggtgggtggggcccccgcaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctcggcctcccaaggtgctgggactacaggcatgagccactgtgcctgaccttacagcagtattttttaaaaatcaaaattaatgcaaaaatccatgatgaggccaggcttggtggctcatgcctgtaattccagcactttgggaggatcccttgagcccaggtgtttgagaccagtttgggtaacataggaagagcttgtctctacaaacaaaaatttaaaaacaatgagctgggcatggaactcacacctctagccccagctactcgggctgaggtgggaggatggcttgagcccaggagttcaaggatgcagtgtgctttgattgcactactgcgcttcaccctgggcaacagagtgagaccccatctctttaaaaaaaaaaaaaaatccatgatgaacaaaacaagtatttgtttgagacggggtctcgctctgtcgcccaggctggagtgcagtggtgccatctcagctcactgcaacctccgccttctgggttcaagcgactctcctgcctcagcctcccgagtagctgggattacaggagcctggcactatgcctggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301778 - DNA, 2232 bp, Homo sapiens
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctagacgtgaaacggagctatgcgagcattgggaagagcataccaggcagagggaactgccactgcgagggcccctgggcgggactgtgctcgggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctcggcctcccaaggtgctgggactacaggcatgagccactgtgcctgaccttacagcagtattttttaaaaatcaaaattaatgcaaaaatccatgatgaggccaggcttggtggctcatgcctgtaattccagcactttgggaggatcccttgagcccaggtgtttgagaccagtttgggtaacataggaagagcttgtctctacaaacaaaaatttaaaaacaatgagctgggcatggaactcacacctctagccccagctactcgggctgaggtgggaggatggcttgagcccaggagttcaaggatgcagtgtgctttgattgcactactgcgcttcaccctgggcaacagagtgagaccccatctctttaaaaaaaaaaaaaaatccatgatgaacaaaacaagtatttgtttgagacggggtctcgctctgtcgcccaggctggagtgcagtggtgccatctcagctcactgcaacctccgccttctgggttcaagcgactctcctgcctcagcctcccgagtagctgggattacaggagcctggcactatgcctggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301779 - DNA, 1983 bp, Homo sapiens
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaatcctgactccgccacttttcccactgtatgatcttgggcaagtcacttcacctctctgtgccttggtttcctcatttataaaatgtggataacaggccgggcgcagtggctcacgcctgtaatcccagcactttgggaggccgaggcaggtggatcacaagatcaggagattgagaccatcggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301780 - DNA, 2355 bp, Homo sapiens
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaagacgtgaaacggagctatgcgagcattgggaagagcataccaggcagagggaactgccactgcgagggcccctgggcgggactgtgctcggtaagcctttggcaatccacgcccagactaggagcctgcacccctaaccaatggaccaccctgtctgtttgcccctccccggggccttctcctggtgggtggggcccccgcaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctcggcctcccaaggtgctgggactacaggcatgagccactgtgcctgaccttacagcagtattttttaaaaatcaaaattaatgcaaaaatccatgatgaggccaggcttggtggctcatgcctgtaattccagcactttgggaggatcccttgagcccaggtgtttgagaccagtttgggtaacataggaagagcttgtctctacaaacaaaaatttaaaaacaatgagctgggcatggaactcacacctctagccccagctactcgggctgaggtgggaggatggcttgagcccaggagttcaaggatgcagtgtgctttgattgcactactgcgcttcaccctgggcaacagagtgagaccccatctctttaaaaaaaaaaaaaaatccatgatgaacaaaacaagtatttgtttgagacggggtctcgctctgtcgcccaggctggagtgcagtggtgccatctcagctcactgcaacctccgccttctgggttcaagcgactctcctgcctcagcctcccgagtagctgggattacaggagcctggcactatgcctggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301781 - DNA, 1753 bp, Homo sapiens
ggacgcgtgggtcgacccacgcgtcgcggacgcgtgggtcggccctacaaccaggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaatcctgactccgccactcggcctcccaaggtgctgggactacaggcatgagccactgtgcctgaccttacagcagtattttttaaaaatcaaaattaatgcaaaaatccatgatgaggccaggcttggtggctcatgcctgtaattccagcactttgggaggatcccttgagcccaggtgtttgagaccagtttgggtaacataggaagagcttgtctctacaaacaaaaatttaaaaacaatgagctgggcatggaactcacacctctagccccagctactcgggctgaggtgggaggatggcttgagcccaggagttcaaggatgcagtgtgctttgattgcactactgcgcttcaccctgggcaacagagtgagaccccatctctttaaaaaaaaaaaaaaatccatgatgaacaaaacaagtatttgtttgagacggggtctcgctctgtcgcccaggctggagtgcagtggtgccatctcagctcactgcaacctccgccttctgggttcaagcgactctcctgcctcagcctcccgagtagctgggattacaggagcctggcactatgcctggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301782 - DNA, 1622 bp, Homo sapiens
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctagacgtgaaacggagctatgcgagcattgggaagagcataccaggcagagggaactgccactgcgagggcccctgggcgggactgtgctcgggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagcctcccgagtagctgggattacaggagcctggcactatgcctggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301783 - DNA, 1384 bp, Homo sapiens
ggacgcgtgggtcgacccacgcgtcgcggacgcgtgggtcggccctacaaccaggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaatcctgactccgccacttttcccactgtatgatcttgggcaagtcacttcacctctctgtgccttggtttcctcatttataaaatgtggataacaggccgggcgcagtggctcacgcctgtaatcccagcactttgggaggccgaggcaggtggatcacaagatcaggagattgagaccatcctggctaacatggtgaaaccccatctggctaatttttgtatttttattggagacaccatgttggtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301784 - DNA, 2083 bp, Homo sapiens
  misc_feature (1620)..(1620): n is a, c, g, or t
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaatcctgactccgccacttttcccactgtatgatcttgggcaagtcacttcacctctctgtgccttggtttcctcatttataaaatgtggataacaggccgggcgcagtggctcacgcctgtaatcccagcactttgggaggccgaggcaggtggatcacaagatcaggagattgagaccatcctggctaacatggtgaaaccccatctctgctgaaaatacaaaaaattagccgggtgtggtggtgggcacctgcagtcccagctacttgggaggctgaggcnggagaatggcgtgaaactgggaggcagagcttgcagtgagccgagatagcgccactgcactccagcctgggcaacagagcgagactccgtctcaaaaataaatataattaattaattatttaattaaaaaaataaaaaataaatgtggataatactagtacctccctcttaaggtcagggctggagctagggtgacatctccagggcagaattttaagaggacaccaaaaaagctcagcaaccaagataaaaaatattttaaagcaatattttgttttgggttttttttttttgagatcaagtatcactcgttacccaggctggaatgtagaggcgagatctcagctcactgaaacctgtgcctccccggttcaagcgattctcctgccacagcctcctgagtagctgggattacaggcatgcgccaccatgcccagctaatttttctatttttagtagagac

SEQ ID NO: 301785 - DNA, 1799 bp, Homo sapiens
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaatcctgactccgccactcggcctcccaaggtgctgggactacaggcatgagccactgtgcctgaccttacagcagtattttttaaaaatcaaaattaatgcaaaaatccatgatgaggccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301786 - DNA, 2034 bp, Homo sapiens
  misc_feature (1620)..(1620): n is a, c, g, or t
caagtgcgcgcggaccgctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaatcctgactccgccacttttcccactgtatgatcttgggcaagtcacttcacctctctgtgccttggtttcctcatttataaaatgtggataacaggccgggcgcagtggctcacgcctgtaatcccagcactttgggaggccgaggcaggtggatcacaagatcaggagattgagaccatcctggctaacatggtgaaaccccatctctgctgaaaatacaaaaaattagccgggtgtggtggtgggcacctgcagtcccagctacttgggaggctgaggcnggagaatggcgtgaaactgggaggcagaagcgagactccgtctcaaaaataaatataattaattaattatttaattaaaaaaataaaaaataaatgtggataatactagtacctccctcttaaggtcagggctggagctagggtgacatctccagggcagaattttaagaggacaccaaaaaagctcagcaaccaagataaaaaatattttaaagcaatattttgttttgggttttttttttttgagatcaagtatcactcgttacccaggctggaatgtagaggcgagatctcagctcactgaaacctgtgcctccccggttcaagcgattctcctgccacagcctcctgagtagctgggattacaggcatgcgccaccatgcccagctaatttttctatttttagtagagac

SEQ ID NO: 301787 - DNA, 554 bp, Homo sapiens
  misc_feature (27)..(27): n is a, c, g, or t
aaagagatggggtctcactctgttgcncagggtgaagcgcagtagtgcaatcaaagcacactgcatccttgaactcctgggctcaagccatcctcccacctcagcccgagtagctggggctagaggtgtgagttccatgcccagctcattgtttttaaatttttgtttgtagagacaagctcttcctatgttacccaaactggtctcaaacacctgggctcaagggatcctcccaaagtgctggaatcacaggcatgagccaccaagcctggcctcatcatggatttttgcattaattttgatttttaaaaaatactgctgtaaggtcaggcatgatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 301788 - DNA, 624 bp, Homo sapiens
atgatttcaccatgttggccaggctggtctcgaactcctgactcaaatgatccccctgcctcctcggcctcccaaggtgctgggactacaggcatgagccactgtgcctgaccttacagcagtattttttaaaaatcaaaattaatgcaaaaatccatgatgaggccaggcttggtggctcatgcctgtaattccagcactttgggaggatcccttgagcccaggtgtttgagaccagtttgggtaacataggaagagcttgtctctacaaacaaaaatttaaaaacaatgagctgggcatggaactcacacctctagccccagctactcgggctgaggtgggaggatggcttgagcccaggagttcaaggatgcagtgtgctttgattgcactactgcgcttcaccctgggcaacagagtgagaccccatctctttaaaaaaaaaaaaaaatccatgatgaacaaaacaagtatttgtttgagacggggtctcgctctgtcgcccaggctggagtgcagtggtgccatctcagctcactgcaacctccgccttctgggttcaagcgactctcctgcctcagcctcccgagtagctgggattacaggagcctggcactatgcct

SEQ ID NO: 301789 - DNA, 374 bp, Homo sapiens
tcccagatacttgggaggctgaggctgaggctgagtctactcaggaggcaacctctgctacccgcttgaacccaggtagcagaagttgcactgagccgagatcttgccagttcattctagcctgggtgaaagagtgaaactctgcctcaaaaaaagaaaagaaaagaaaagaaaagaaaagaaacataaacatatcgtaacactcatttgacataaaaatgatctattttatgatggtccatttctctcagcacatcctgacagctattttaaaaacatgtcatgccagaagatctgttctgtttccctctgtatctccatgtatctgtctttgcgtctgtctgttgtctctctctcagaggaggaggagaaag

SEQ ID NO: 301790 - DNA, 862 bp, Homo sapiens
gagatggggttttgccatgttgcccaggctggccttgaactcctgagctcaagtgatccccctcacctcagccaaagtgctgggattacaggcatgagccaccacgcctggccagaatcaatcactttagatcagtcctcagccatcacctaagagtcccaagtaaactccttataaggctgagaggcaatcgctgatatccctgctttgaacttgaccctcttacaagatttacatactctttaatgatggaatgataaaagtggtggtgtccagcagaactttctgtgataatgaaaatgttctatattctgtaaatgtctataggtgtctataaacatctatacgtgttctatattggccactagccacagttagttgtggagtacttgaaatgtgtcttgtgtgactgaagagctgaattttctattttaattaattgagaatttaaattgcctcatgtggctagtggctgcctattggacagcacagatgtatctcattgctactcaaaatgtggtccccagaccaggagcattgctatcacctgggaacttattagaaatgaggactctcagccgggcatggtggctcacgcctgtaatcctagcactttgggaggccaaggcgggcggattgtctgagctcgggagttcgagaccagcctgggcaacacagtgaaaccctgactctactaaaaaatacaaaaattagctgggcgtggcggcatgcacctgtagtcccagctactcgggaggctgagggaggagaatcacttgaacccaggaggcagagcttgcagtgagctgagatcgctcaactgcactccagcctgggcgacagagggacactccatctccta

SEQ ID NO: 301791 - DNA, 605 bp, Homo sapiens
gcctcctcggagttgcccctctgcaagccaacaattcgggatagaaaacacctccgtggtgttttcccggggccctcccgcgccgcgttcggccgccagcccgctcgagctcccgcgccaacgcctcaggggttcgccctctgacaggactaacccgatataccttctgcaataatgaattagactagaaataactttgcaaggagagccaaagctaagacccccgaaaccagacgagctacctaagaacagctaaaagagcacacccgtctatgtagcaaaatagtgggaagatttataggtagaggcgagaactaccgagtcctggtgataggtggttgtccaagatagaatcttagttcaacttaaattacgcccacagaagcctctaaatccccttgtacagttctaactgttagtccagagaggaacagctcttggacactaggacaacaagcgtgtagagagagtaaaaaattaacagccatagtaggcctaaaagcagacaccaattaagaaaggtcgagctcaacgacaaacaggcacaaagaagaaggggacaaaggacacaccccgcacgcgggctcacccagaagacccaccag

SEQ ID NO: 301792 - DNA, 438 bp, Homo sapiens
ataatgcccagtccagatgttgtatactgtccattgatatgcttcagtatgcatgggaacagagaatgggctccaggacaatgacatcaagctgagggtcagtgagtgggaagtgatccaggagtcgggcacgaaactgaagccaatgtatggtcctggctacacgggtctgaagaacctgggcaacagctgctatctcagctctgtcatgcaggccatcttcagcatcccagaattccagagagcgtatgtaggaaaccttcccagaatatttgactactcgcctttagatccaacacaagatttcaacacacagatgactaagttaggacatggccttctctcaggccagtattcaaagcctccggtgaaatctgaactcattgaacaggtgatgaaggaggagcacaagccacagcagaacgcgatactccgacg

SEQ ID NO: 301793 - DNA, 5944 bp, Homo sapiens
  misc_feature (5915)..(5916): n is a, c, g, or t
cgcggaattccgcggaattccgcgccgccgccgccggcagaccccgcgctccggctccggctcggctcgctcggctccggtgcgcgccgaggccatgcagcgccggggcgccctgttcggcatgccgggcggcagcggaggcaggaagatggctgcaggagacatcggcgagctgctagtgccccacatgcccacgatccgcgtgcccaggtccggcgacagggtctacaagaacgagtgcgccttctcctacgactctcccaattctgaaggtggactctatgtatgcatgaatacatttttggcctttggaagggaacatgttgaaagacattttcgaaaaactggacagagtgtatacatgcacctgaaaagacatgtgcgagagaaggtaagaggggcgtctggtggagcgttaccaaaaaggaggaattccaagatttttttagatctagatactgatgacgatttaaatagcgacgattatgaatatgaagatgaagccaaacttgttatattcccagatcactatgaaatagcactaccaaatattgaggagttaccagccctggtaacaattgcttgtgatgcagttctcagctcaaaatctccatacagaaagcaggacccagacacgtgggaaaatgaattgccagtatctaaatatgccaacaacctcacccagctggacaatggagtcaggattcctccaagtggttggaagtgtgccagatgcgacctgcgagaaaacctctggttgaatctgactgacggctctgtcctgtgtggaaagtggttctttgacagctctgggggcaacgggcatgcgctggagcattacagagacatgggctacccactagccgtgaaactgggaaccatcactcctgacggggcagatgtttattcttttcaagaagaagaacctgttttggatcctcatttggccaagcacttagcgcattttggaattgatatgcttcatatgcatgggacagagaatgggctccaggacaatgacatcaagctgagggtcagtgagtgggaagtgatccaggagtcgggcacgaaactgaagccaatgtatggtcctggctacacgggtctgaagaacctgggcaacagctgctatctcagctctgtcatgcaggccatcttcagcatcccagaattccagagagcgtatgtaggaaaccttcccagaatatttgactactcgcctttagatccaacacaagatttcaacacacagatgactaagttaggacatggccttctctcaggccagtattcaaagcctccggtgaaatctgaactcattgaacaggtgatgaaggaggagcacaagccacagcagaacgggatctctccgcgcatgtttaaggcctttgtaagcaagagccacccggaattctcctctaacaggcagcaagatgcccaggaattcttcttgcacctggtgaatctagtagagaggaaccgcatcggctcagaaaacccaagcgatgtttttcgttttttggtggaagaacgcattcagtgctgtcagacccggaaagtccgctacacggagagggtggattacctgatgcagttacctgtggccatggaggcggcaaccaacaaggatgaactgatcgcttatgaactaacgagaagggaagcagaagcaaacagaagaccccttcctgagttggtacgtgccaagataccatttagtgcctgccttcaggccttctctgaaccagaaaatgttgatgatttctggagcagtgccctacaagcaaagtctgcgggtgtgaaaacatctcgctttgcttcattccctgaatacttggtagtgcagataaagaagttcacttttggtcttgactgggttcccaaaaaatttgatgtttctattgatatgccagacctacttgatatcaaccatctccgagccagggggttacagccaggagaggaagaacttccagacatcagcccccccatagtcattcctgatgactcaaaagatcgcctgatgaaccaattgatagacccatcagacatcgatgagtcatcagtgatgcagctggccgagatgggtttcccgctggaagcatgtcgcaaggctgtgtacttcactggaaatatgggcgccgaggtggccttcaactggatcattgttcacatggaagagccagattttgctgagccgctgaccatgcctggttatggaggggcagcttctgctggagcctctgtttttggtgcttctggactggataaccaacctccagaggaaatcgtagctatcatcacctccatgggatttcagcgaaatcaggctattcaggcactacgagcaacgaataataacctggaaagagcactggattggatctttagccaccctgagtttgaagaagacagtgattttgtgattgagatggagaataatgccaatgcaaacattatttctgaggccaagcccgaaggacctagagtcaaggatggatctggaacatatgagctatttgcattcatcagtcacatgggaacatccacaatgagtggtcattacatttgccatatcaaaaaggaaggaagatgggtgatttacaatgaccacaaagtttgtgcctcagaaaggccccctaaagacctgggctacatgtacttttaccgcaggataccaagctaaacctcaaatataaaaattggcgaaaagaagccatacgcctttttaatttgccaaaaaaaaaaagaagaagaagaagttgaaacaactagacatgaaggaatatatggggtatttatcgtttatttaaagagcacgatcagttgacaccttctgaaatagaactgagaagaaatttctattagtgatgatacactattatattgtagatagtttttataaatgttcaaaaagatgatgatatttaaaaacaaaaaaagtattcatattgctggtggaggatctgccatcagcacatcaaaaatggggatgtgcccccagccctctattttgctttgggggtcagtgatagtggcctctggagaaaccaaataatgtggccagtggtgtggccttacccacaacaaatgaaaagcccacttgtgtttcatatagaaaatcagcagttgggtggggctttatttgtgacataatttttttcatgacatacaataatttctgatgtatccatgtagatattatgctctgtccataatagagcctctgcaatgaaagatatttttaatttgtcacattaaaattcataatacgattgtgtgaatgtgtgtgagactgactgagagtgtgagacttttactagaaaagtgagtccactagaaaatctgtgacaagttggtttttaaagtctgaacagttgatattaagcatatctgaaaaaagcaagtaaatattttaacaaaactatgactcaggaaccttcgagaagattagttccccacttagatttttaaggagtaaaaagggctgagttatgcctttaagtgctgtcaagaattcacttgggtttgggacatttgctggtgtaatgctagatgcccacagcagcataatattgtactttgtcaaaggtaggtaaattctctgtttctcagcagccctttccccaaaaggtatggtgtttatttttagtaaaaatagctaatctctttttaccatctcacatgataactctttggagtcatgtcaagtgccccaaatttgtctgtgattttcccatctctgagctctttatctgcctccgtttccttgtttttctggggccagagtctcatctctgcctttttttggtgtatcaccttctgacttgccttcattgcttgtctgatgtgaccaacagtgtgatcttggacacactaaggattttagatgcaaagaaactttatacaacattatgaaagactatcctttccattttggttatttcagcattttagttgcaacctgggattagattagagtttccaacgtgatgaaaagtggaatgatagcattctataatttccataattttcctactggtccgtaccaaattctagagtctctggagttgctatttcagagtatttggtcaaacgaaaaagaatttattgctgtctgtttaacatgtatttgtttggttgaaaggatctttttagaaactgtaggaaaataaacagaaccaaccaggtgaaacaaagcacagacattgggttaggatgtagtgagttgtgaacaatcaggattctgggtgtgatgggggtccctgtctcataggtgatcctttggtgccatgtgaccgagagacatggtgtctaaggcccatggcctggagacctgggtgctgctcctagctgactgtggaccttgggcaagtccttcatccgtcctgtgcctcactgtcctcatctgaacaatggtatgatgacacctgccctctctttcaatcatgctttgaggatacagtgagattggttacagtgaaccttcaatgagtagaatgtggtatgccatggtgggttgtagtagatggtgctccctgccttttctcctctgttttcctcaatttgggaacaaatgagattggcagaaggagggagctcacggtgcagtacttttctaccaaagtgtgcccactggtgtcacctcctaatgttaacttggatttcctaaagcagtcccactctgttatgagagtcactgactcccgtggacatccccacagtaagcagccttacaaaatccagtccccttagggcagagtgagtgtcatagaataatgactccaaacccacgtcaaaaatggcttgttttcagcgatgttataaaacaaaggcctgttttttggaattgggggtgactgggtggtttggattgaaatgtggacaaagatagcatgtgtattttgaataaaataaaaattttgtaataaaacttttaaaaatcagtgatgtaaaatcaatatttaagactataggctataaattgtttgatttcattaactagcccttttgatgcctagacatgttgtaaaaaaattgtgctatggctgccttttcttctgccccacaacacaaagggctatttctacaaggcaaagttttgtatatgtgctattctttacttcagattgagagttgggaaaaactggagtaaataatgggtttcttacttgcttaaaagcatatttatatgtgtatctcaatatatacaaggcaggttcccctataaaagtctggaatgtactgcttaattttacacttgtgtagacacgattatttgtgactgaaaagtggaataacgtgtggattttgtcaactcattatcagtctgttagcagtcctctatgtgaggcatggtggtctaattgtgaaattctccctgtatatgggtgtctgtgtgaaagacagcactttcttcctgtaaatatcttttgatatccatttatgtagaattccaatgaatatgtctttggaaaaggtaatgtatcaaagtttttattttgccaattgatctaaatgcccatataactaatcagaaatccagtttggttcagattgggattttcttttaaagaaaaaaaaagtatgcagaaaagactattggaagaatcatgtgttagtgacactttacatcaacgttgcttcaatattttggaattgaccaggctgctttctcctacctgcaagagaatgtgcctgacatttcccagtgcttactttgggctataggaagtccagcggggatagctcgagcctcttgctccctgagtcatttattccctttacctgaacagagccttacctgcaattcatagtgagagcacctgggtctgtatcctgactccactctaagtgaggtgggactgaatcactgtacctctctggggacatttcccagtgcacactttggagcnnatctagtctaacccacttgtttcaaatg

SEQ ID NO: 301794 - DNA, 5890 bp, Homo sapiens
  misc_feature (5861)..(5862): n is a, c, g, or t
cgcggaattccgcggaattccgcgccgccgccgccggcagaccccgcgctccggctccggctcggctcgctcggctccggtgcgcgccgaggccatgcagcgccggggcgccctgttcggcatgccgggcggcagcggaggcaggaagatggctgcaggagacatcggcgagctgctagtgccccacatgcccacgatccgcgtgcccaggtccggcgacagggtctacaagaacgagtgcgccttctcctacgactctcccaattctgaaggtggactctatgtatgcatgaatacatttttggcctttggaagggaacatgttgaaagacattttcgaaaaactggacagagtgtatacatgcacctgaaaagacatgtgcgagagaaggtaagaggggcgtctggtggagcgttaccaaaaaggaggaattccaagatttttttagatctagatactgatgacgatttaaatagcgacgattatgaatatgaagatgaagccaaacttgttatattcccagatcactatgaaatagcactaccaaatattgaggagttaccagccctggtaacaattgcttgtgatgcagttctcagctcaaaatctccatacagaaagcaggacccagacacgtgggaaaatgaattgccagtatctaaatatgccaacaacctcacccagctggacaatggagtcaggattcctccaagtggttggaagtgtgccagatgcgacctgcgagaaaacctctggttgaatctgactgacggctctgtcctgtgtggaaagtggttctttgacagctctgggggcaacgggcatgcgctggagcattacagagacatgggctacccactagccgtgaaactgggaaccatcactcctgacggggcagatgtttattcttttcaagaagaagaacctgttttggatcctcatttggccaagcacttagcgcattttggaattgatatgcttcatatgcatgggacagagaatgggctccaggacaatgacatcaagctgagggtcagtgagtgggaagtgatccaggagtcgggcacgaaactgaagccaatgtatggtcctggctacacgggtctgaagaacctgggcaacagctgctatctcagctctgtcatgcaggccatcttcagcatcccagaattccagagagcgtatgtaggaaaccttcccagaatatttgactactcgcctttagatccaacacaagatttcaacacacagatgactaagttaggacatggccttctctcaggccagtattcaaagcctccggtgaaatctgaactcattgaacaggtgatgaaggaggagcacaagccacagcagaacgggatctctccgcgcatgtttaaggcctttgtaagcaagagccacccggaattctcctctaacaggcagcaagatgcccaggaattcttcttgcacctggtgaatctagtagagaggaaccgcatcggctcagaaaacccaagcgatgtttttcgttttttggtggaagaacgcattcagtgctgtcagacccggaaagtccgctacacggagagggtggattacctgatgcagttacctgtggccatggaggcggcaaccaacaaggatgaactgatcgcttatgaactaacgagaagggaagcagaagcaaacagaagaccccttcctgagttggtacgtgccaagataccatttagtgcctgccttcaggccttctctgaaccagaaaatgttgatgatttctggagcagtgccctacaagcaaagtctgcgggtgtgaaaacatctcgctttgcttcattccctgaatacttggtagtgcagataaagaagttcacttttggtcttgactgggttcccaaaaaatttgatgtttctattgatatgccagacctacttgatatcaaccatctccgagccagggggttacagccaggagaggaagaacttccagacatcagcccccccatagtcattcctgatgactcaaaagatcgcctgatgaaccaattgatagacccatcagacatcgatgagtcatcagtgatgcagctggccgagatgggtttcccgctggaagcatgtcgcaaggctgtgtacttcactggaaatatgggcgccgaggtggccttcaactggatcattgttcacatggaagagccagattttgctgagccgctgaccatgcctggttatggaggggcagcttctgctggagcctctgtttttggtgcttctggactggataaccaacctccagaggaaatcgtagctatcatcacctccatgggatttcagcgaaatcaggctattcaggcactacgagcaacgaataataacctggaaagagcactggattggatctttagccaccctgagtttgaagaagacagtgattttgtgattgagatggagaataatgccaatgcaaacattatttctgaggccaagcccgaaggacctagagtcaaggatggatctggaacatatgagctatttgcattcatcagtcacatgggaacatccacaatgagtggtcattacatttgccatatcaaaaaggaaggaagatgggtgatttacaatgaccacaaagtttgtgcctcagaaaggccccctaaagacctgggctacatgtacttttaccgcaggataccaagctaaacctcaaatataaaaattggcgaaaagaagccatacgcctttttaatttgccaaaaaaaaaaagaagaagaagaagttgaaacaactagacatgaaggaatatatggggtatttatcgtttatttaaagagcacgatcagttgacaccttctgaaatagaactgagaagaaatttctattagtgatgatacactattatattgtagatagtttttataaatgttcaaaaagatgatgatatttaaaaacaaaaaaagtattcatattgctggtggaggatctgccatcagcacatcaaaaatggggatgtgcccccagccctctattttgctttgggggtcagtgatagtggcctctggagaaaccaaataatgtggccagtggtgtggccttacccacaacaaatgaaaagcccacttgtgtttcatatagaaaatcagcagttgggtggggctttatttgtgacataatttttttcatgacatacaataatttctgatgtatccatgtagatattatgctctgtccataatagagcctctgcaatgaaagatatttttaatttgtcacattaaaattcataatacgattgtgtgaatgtgtgtgagactgactgagagtgtgagacttttactagaaaagtgagtccactagaaaatctgtgacaagttggtttttaaagtctgaacagttgatattaagcatatctgaaaaaagcaagtaaatattttaacaaaactatgactcaggaaccttcgagaagattagttccccacttagatttttaaggagtaaaaagggctgagttatgcctttaagtgctgtcaagaattcacttgggtttgggacatttgctggtgtaatgctagatgcccacagcagcataatattgtactttgtcaaaggtaggtaaattctctgtttctcagcagccctttccccaaaaggtatggtgtttatttttagtcaagtgccccaaatttgtctgtgattttcccatctctgagctctttatctgcctccgtttccttgtttttctggggccagagtctcatctctgcctttttttggtgtatcaccttctgacttgccttcattgcttgtctgatgtgaccaacagtgtgatcttggacacactaaggattttagatgcaaagaaactttatacaacattatgaaagactatcctttccattttggttatttcagcattttagttgcaacctgggattagattagagtttccaacgtgatgaaaagtggaatgatagcattctataatttccataattttcctactggtccgtaccaaattctagagtctctggagttgctatttcagagtatttggtcaaacgaaaaagaatttattgctgtctgtttaacatgtatttgtttggttgaaaggatctttttagaaactgtaggaaaataaacagaaccaaccaggtgaaacaaagcacagacattgggttaggatgtagtgagttgtgaacaatcaggattctgggtgtgatgggggtccctgtctcataggtgatcctttggtgccatgtgaccgagagacatggtgtctaaggcccatggcctggagacctgggtgctgctcctagctgactgtggaccttgggcaagtccttcatccgtcctgtgcctcactgtcctcatctgaacaatggtatgatgacacctgccctctctttcaatcatgctttgaggatacagtgagattggttacagtgaaccttcaatgagtagaatgtggtatgccatggtgggttgtagtagatggtgctccctgccttttctcctctgttttcctcaatttgggaacaaatgagattggcagaaggagggagctcacggtgcagtacttttctaccaaagtgtgcccactggtgtcacctcctaatgttaacttggatttcctaaagcagtcccactctgttatgagagtcactgactcccgtggacatccccacagtaagcagccttacaaaatccagtccccttagggcagagtgagtgtcatagaataatgactccaaacccacgtcaaaaatggcttgttttcagcgatgttataaaacaaaggcctgttttttggaattgggggtgactgggtggtttggattgaaatgtggacaaagatagcatgtgtattttgaataaaataaaaattttgtaataaaacttttaaaaatcagtgatgtaaaatcaatatttaagactataggctataaattgtttgatttcattaactagcccttttgatgcctagacatgttgtaaaaaaattgtgctatggctgccttttcttctgccccacaacacaaagggctatttctacaaggcaaagttttgtatatgtgctattctttacttcagattgagagttgggaaaaactggagtaaataatgggtttcttacttgcttaaaagcatatttatatgtgtatctcaatatatacaaggcaggttcccctataaaagtctggaatgtactgcttaattttacacttgtgtagacacgattatttgtgactgaaaagtggaataacgtgtggattttgtcaactcattatcagtctgttagcagtcctctatgtgaggcatggtggtctaattgtgaaattctccctgtatatgggtgtctgtgtgaaagacagcactttcttcctgtaaatatcttttgatatccatttatgtagaattccaatgaatatgtctttggaaaaggtaatgtatcaaagtttttattttgccaattgatctaaatgcccatataactaatcagaaatccagtttggttcagattgggattttcttttaaagaaaaaaaaagtatgcagaaaagactattggaagaatcatgtgttagtgacactttacatcaacgttgcttcaatattttggaattgaccaggctgctttctcctacctgcaagagaatgtgcctgacatttcccagtgcttactttgggctataggaagtccagcggggatagctcgagcctcttgctccctgagtcatttattccctttacctgaacagagccttacctgcaattcatagtgagagcacctgggtctgtatcctgactccactctaagtgaggtgggactgaatcactgtacctctctggggacatttcccagtgcacactttggagcnnatctagtctaacccacttgtttcaaatg

SEQ ID NO: 301795 - DNA, 6320 bp, Homo sapiens
  misc_feature (6291)..(6292): n is a, c, g, or t
gcctcctcggagttgcccctctgcaagccaacaattcgggatagaaaacacctccgtggtgttttcccggggccctcccgcgccgcgttcggccgccagcccgctcgagctcccgcgccaacgcctcaggggttcgccctccgccccccgccgccgcgcccggcccacgcgcagggcccctctccagcgccccctccccggcacgctgcggctggcgctccccagccccgcctgacgctgcagctgggccggagactcgccattggattaaaaatagcgtcgccagtccgccccaagcccgcggtgcccgctcccgccccgcagcccgctctccccgcccgccccggctcggccggctgccgttgcccgcgcagcccgcccgtcagcccgctcgctggcgccgccgccgccggcagaccccgcgctccggctccggctcggctcgctcggctccggtgcgcgccgaggccatgcagcgccggggcgccctgttcggcatgccgggcggcagcggaggcaggaagatggctgcaggagacatcggcgagctgctagtgccccacatgcccacgatccgcgtgcccaggtccggcgacagggtctacaagaacgagtgcgccttctcctacgactctcccaattctgaaggtggactctatgtatgcatgaatacatttttggcctttggaagggaacatgttgaaagacattttcgaaaaactggacagagtgtatacatgcacctgaaaagacatgtgcgagagaaggtaagaggggcgtctggtggagcgttaccaaaaaggaggaattccaagatttttttagatctagatactgatgacgatttaaatagcgacgattatgaatatgaagatgaagccaaacttgttatattcccagatcactatgaaatagcactaccaaatattgaggagttaccagccctggtaacaattgcttgtgatgcagttctcagctcaaaatctccatacagaaagcaggacccagacacgtgggaaaatgaattgccagtatctaaatatgccaacaacctcacccagctggacaatggagtcaggattcctccaagtggttggaagtgtgccagatgcgacctgcgagaaaacctctggttgaatctgactgacggctctgtcctgtgtggaaagtggttctttgacagctctgggggcaacgggcatgcgctggagcattacagagacatgggctacccactagccgtgaaactgggaaccatcactcctgacggggcagatgtttattcttttcaagaagaagaacctgttttggatcctcatttggccaagcacttagcgcattttggaattgatatgcttcatatgcatgggacagagaatgggctccaggacaatgacatcaagctgagggtcagtgagtgggaagtgatccaggagtcgggcacgaaactgaagccaatgtatggtcctggctacacgggtctgaagaacctgggcaacagctgctatctcagctctgtcatgcaggccatcttcagcatcccagaattccagagagcgtatgtaggaaaccttcccagaatatttgactactcgcctttagatccaacacaagatttcaacacacagatgactaagttaggacatggccttctctcaggccagtattcaaagcctccggtgaaatctgaactcattgaacaggtgatgaaggaggagcacaagccacagcagaacgggatctctccgcgcatgtttaaggcctttgtaagcaagagccacccggaattctcctctaacaggcagcaagatgcccaggaattcttcttgcacctggtgaatctagtagagaggaaccgcatcggctcagaaaacccaagcgatgtttttcgttttttggtggaagaacgcattcagtgctgtcagacccggaaagtccgctacacggagagggtggattacctgatgcagttacctgtggccatggaggcggcaaccaacaaggatgaactgatcgcttatgaactaacgagaagggaagcagaagcaaacagaagaccccttcctgagttggtacgtgccaagataccatttagtgcctgccttcaggccttctctgaaccagaaaatgttgatgatttctggagcagtgccctacaagcaaagtctgcgggtgtgaaaacatctcgctttgcttcattccctgaatacttggtagtgcagataaagaagttcacttttggtcttgactgggttcccaaaaaatttgatgtttctattgatatgccagacctacttgatatcaaccatctccgagccagggggttacagccaggagaggaagaacttccagacatcagcccccccatagtcattcctgatgactcaaaagatcgcctgatgaaccaattgatagacccatcagacatcgatgagtcatcagtgatgcagctggccgagatgggtttcccgctggaagcatgtcgcaaggctgtgtacttcactggaaatatgggcgccgaggtggccttcaactggatcattgttcacatggaagagccagattttgctgagccgctgaccatgcctggttatggaggggcagcttctgctggagcctctgtttttggtgcttctggactggataaccaacctccagaggaaatcgtagctatcatcacctccatgggatttcagcgaaatcaggctattcaggcactacgagcaacgaataataacctggaaagagcactggattggatctttagccaccctgagtttgaagaagacagtgattttgtgattgagatggagaataatgccaatgcaaacattatttctgaggccaagcccgaaggacctagagtcaaggatggatctggaacatatgagctatttgcattcatcagtcacatgggaacatccacaatgagtggtcattacatttgccatatcaaaaaggaaggaagatgggtgatttacaatgaccacaaagtttgtgcctcagaaaggccccctaaagacctgggctacatgtacttttaccgcaggataccaagctaaacctcaaatataaaaattggcgaaaagaagccatacgcctttttaatttgccaaaaaaaaaaagaagaagaagaagttgaaacaactagacatgaaggaatatatggggtatttatcgtttatttaaagagcacgatcagttgacaccttctgaaatagaactgagaagaaatttctattagtgatgatacactattatattgtagatagtttttataaatgttcaaaaagatgatgatatttaaaaacaaaaaaagtattcatattgctggtggaggatctgccatcagcacatcaaaaatggggatgtgcccccagccctctattttgctttgggggtcagtgatagtggcctctggagaaaccaaataatgtggccagtggtgtggccttacccacaacaaatgaaaagcccacttgtgtttcatatagaaaatcagcagttgggtggggctttatttgtgacataatttttttcatgacatacaataatttctgatgtatccatgtagatattatgctctgtccataatagagcctctgcaatgaaagatatttttaatttgtcacattaaaattcataatacgattgtgtgaatgtgtgtgagactgactgagagtgtgagacttttactagaaaagtgagtccactagaaaatctgtgacaagttggtttttaaagtctgaacagttgatattaagcatatctgaaaaaagcaagtaaatattttaacaaaactatgactcaggaaccttcgagaagattagttccccacttagatttttaaggagtaaaaagggctgagttatgcctttaagtgctgtcaagaattcacttgggtttgggacatttgctggtgtaatgctagatgcccacagcagcataatattgtactttgtcaaaggtaggtaaattctctgtttctcagcagccctttccccaaaaggtatggtgtttatttttagtaaaaatagctaatctctttttaccatctcacatgataactctttggagtcatgtcaagtgccccaaatttgtctgtgattttcccatctctgagctctttatctgcctccgtttccttgtttttctggggccagagtctcatctctgcctttttttggtgtatcaccttctgacttgccttcattgcttgtctgatgtgaccaacagtgtgatcttggacacactaaggattttagatgcaaagaaactttatacaacattatgaaagactatcctttccattttggttatttcagcattttagttgcaacctgggattagattagagtttccaacgtgatgaaaagtggaatgatagcattctataatttccataattttcctactggtccgtaccaaattctagagtctctggagttgctatttcagagtatttggtcaaacgaaaaagaatttattgctgtctgtttaacatgtatttgtttggttgaaaggatctttttagaaactgtaggaaaataaacagaaccaaccaggtgaaacaaagcacagacattgggttaggatgtagtgagttgtgaacaatcaggattctgggtgtgatgggggtccctgtctcataggtgatcctttggtgccatgtgaccgagagacatggtgtctaaggcccatggcctggagacctgggtgctgctcctagctgactgtggaccttgggcaagtccttcatccgtcctgtgcctcactgtcctcatctgaacaatggtatgatgacacctgccctctctttcaatcatgctttgaggatacagtgagattggttacagtgaaccttcaatgagtagaatgtggtatgccatggtgggttgtagtagatggtgctccctgccttttctcctctgttttcctcaatttgggaacaaatgagattggcagaaggagggagctcacggtgcagtacttttctaccaaagtgtgcccactggtgtcacctcctaatgttaacttggatttcctaaagcagtcccactctgttatgagagtcactgactcccgtggacatccccacagtaagcagccttacaaaatccagtccccttagggcagagtgagtgtcatagaataatgactccaaacccacgtcaaaaatggcttgttttcagcgatgttataaaacaaaggcctgttttttggaattgggggtgactgggtggtttggattgaaatgtggacaaagatagcatgtgtattttgaataaaataaaaattttgtaataaaacttttaaaaatcagtgatgtaaaatcaatatttaagactataggctataaattgtttgatttcattaactagcccttttgatgcctagacatgttgtaaaaaaattgtgctatggctgccttttcttctgccccacaacacaaagggctatttctacaaggcaaagttttgtatatgtgctattctttacttcagattgagagttgggaaaaactggagtaaataatgggtttcttacttgcttaaaagcatatttatatgtgtatctcaatatatacaaggcaggttcccctataaaagtctggaatgtactgcttaattttacacttgtgtagacacgattatttgtgactgaaaagtggaataacgtgtggattttgtcaactcattatcagtctgttagcagtcctctatgtgaggcatggtggtctaattgtgaaattctccctgtatatgggtgtctgtgtgaaagacagcactttcttcctgtaaatatcttttgatatccatttatgtagaattccaatgaatatgtctttggaaaaggtaatgtatcaaagtttttattttgccaattgatctaaatgcccatataactaatcagaaatccagtttggttcagattgggattttcttttaaagaaaaaaaaagtatgcagaaaagactattggaagaatcatgtgttagtgacactttacatcaacgttgcttcaatattttggaattgaccaggctgctttctcctacctgcaagagaatgtgcctgacatttcccagtgcttactttgggctataggaagtccagcggggatagctcgagcctcttgctccctgagtcatttattccctttacctgaacagagccttacctgcaattcatagtgagagcacctgggtctgtatcctgactccactctaagtgaggtgggactgaatcactgtacctctctggggacatttcccagtgcacactttggagcnnatctagtctaacccacttgtttcaaatg

SEQ ID NO: 301796 - DNA, 1045 bp, Homo sapiens
gcctcctcggagttgcccctctgcaagccaacaattcgggatagaaaacacctccgtggtgttttcccggggccctcccgcgccgcgttcggccgccagcccgctcgagctcccgcgccaacgcctcaggggttcgccctccgccccccgccgccgcgcccggcccacgcgcagggcccctctccagcgccccctccccggcacgctgcggctggcgctccccagccccgcctgacgctgcagctgggccggagactcgccattggattaaaaatagcgtcgccagtccgccccaagcccgcggtgcccgctcccgccccgcagcccgctctccccgcccgccccggctcggccggctgccgttgcccgcgcagcccgcccgtcagcccgctcgctggcgccgccgccgccggcagaccccgcgctccggctccggctcggctcgctcggctccggtgcgcgccgaggccatgcagcgccggggcgccctgttcggcatgccgggcggcagcggaggcaggaagatggctgcaggagacatcggcgagctgctagtgccccacatgcccacgatccgcgtgcccaggtccggcgacagggtctacaagaacgagtgcgccttctcctacgactctcccaattctgaaggtggactctatgtatgcatgaatacatttttggcctttggaagggaacatgttgaaagacattttcgaaaaactggacagagtgtatacatgcacctgaaaagacatgtgcgagagatctagatactgatgacgatttaaatagcgacgattatgaatatgaagatgaagccaaacttgttatattcccagatcactatgaaatagcactaccaaatattgaggagttaccagccctggtaacaattgcttgtgatgcagttctcagctcaaaatctccatacagaaagcaggacccagacacgtgggaaaatgaattgccagtatctaaatatgccaacaacctcacccagctggacaatggagtcaggattcctccaaggtgagagtcagatagc

SEQ ID NO: 301797 - DNA, 568 bp, Homo sapiens
gcatgtcgcaaggctgtgtacttcactggaaatatgggcgccgaggtggccttcaactggatcattgttcacatggaagagccaggtaggtggcgagaaaatggaatggctttggagtctgatgtgaccctcagtgatgctgagtcctggtccttccaaggtccctgtggatgtatccctagaaaatgactttatagttcctaatctcctgcagtggaggagaaagccagtctttttcttcttctttttttttttaaaaacagcagctttaggccaggcgtgggggctcatgcctgtaatcccagcactttgggaggccaaggcaggcggatcacgaagtcaagagatgaagaccatcctggccaacatagtgaaaccccatctctactaaagatacaaaaattagctgggcatggtggtgcgtacctgtagtcccagctactcaggaggctgaggcaggagaatcgcttgaacgcaggaggcggaggctgcagtgagccaagattgcaccactgcactctggcctgagtgacagagcgagactctgtctcaaaaaaacaaacaaaca

SEQ ID NO: 301798 - DNA, 134 bp, Homo sapiens
tcctgactgtgcttgcaggtggacgtgccccatgtgaaatgcaaagaccaggaaccgcagcccttgggggagagcaaggagcatccgcggtgggaagagaactgcgaggaggaagctggtggagggccagctag

SEQ ID NO: 301799 - DNA, 616 bp, Homo sapiens
gaattgtaatataaattcgtattattgccaccacgtaggacacagaacagctccatcgccctgtacatgtcctgttgctgcctttgtgtagtcactggagatgtgggttttatttttattattttctccatttgatagatagtgccgacttgattcacttcatccattccagggccaatttttcactgttgattgtcaggggctctgctctgctgtttctccagccctctccagtgaaagagatgtaactgcagtgccatagttgtcagcttgttagttattggcaagtcttggttggattttctattcttcattgtgggctgtccttgcctgtacacctagcatgctctggaaccctttgtggatttatgagaattcaagctaattccaacagtggccaaagaaaaaaatagccagggaaatatgttattgctaaccatataggcctcagagtgaaaacggcttttggagtattctgctttgaattatttattttagtctttctcagatgtcaggacagatttttaagatttgggcataatgtttaaaatgaagatggtatgtctgtagattttattgacccaacttggtccccccaggctgtcctcacctgccc

SEQ ID NO: 301800 - DNA, 225 bp, Homo sapiens
tatacgggtgcgagaagacgacagccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301801 - DNA, 630 bp, Homo sapiens
tatacgggtgcgagaagacgacagccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaacaggaaaataaaatatgaatacaatccagcccggagctggagtgcaagatggagagggcgcgggcttctagggacctcagtgacactgggtgcccgaacctgattgagcaggtgggactgggtgtccccaggctgttgggaaaagggtggcacatagggtcccagtgttgggtggtgtgtcgcctgctgtgaaagttcaggacagaggcctcagcctcagggtcacctccctggacaaggtgaatcagaactcacccttgaaggataaacaggatttaagtgaatgaggggacctggacttctgtccgaacaacaagtgtttgctgaggcctcctgtgggccaggcactgggttggccattctagagatggagacattcacccaataaatgtttccagagcattaac

SEQ ID NO: 301802 - DNA, 2028 bp, Homo sapiens
gctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301803 - DNA, 2433 bp, Homo sapiens
gctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaacaggaaaataaaatatgaatacaatccagcccggagctggagtgcaagatggagagggcgcgggcttctagggacctcagtgacactgggtgcccgaacctgattgagcaggtgggactgggtgtccccaggctgttgggaaaagggtggcacatagggtcccagtgttgggtggtgtgtcgcctgctgtgaaagttcaggacagaggcctcagcctcagggtcacctccctggacaaggtgaatcagaactcacccttgaaggataaacaggatttaagtgaatgaggggacctggacttctgtccgaacaacaagtgtttgctgaggcctcctgtgggccaggcactgggttggccattctagagatggagacattcacccaataaatgtttccagagcattaac

SEQ ID NO: 301804 - DNA, 2309 bp, Homo sapiens
gctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggtagggccccgcagagcctctgcgcagagccaactacgtcccgcggcccacgtggtccgttcaggctgggttctgccagccacactgccctcccctccgcagagtctttcctcaggccccaccctgctcgactgggagccaggtctagtccaagcacagaggcgggccccacgctggctcccacgcctggtcggggaggggccctcctttctgttggggtgggcctcccaaagcctggcagggcaggggctcagccagcgcccacctgcctcctccctcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301805 - DNA, 2035 bp, Homo sapiens
  misc_feature (30)..(30): n is a, c, g, or t
accgtagtgttggtacaatatagaaccccnttttggtattttaaagagccagggctgtcggtcgaatctgggattgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301806 - DNA, 2472 bp, Homo sapiens
gctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaacaaaaaaacatcaagaaagaaagcagaaaaacacagggcgggcccgcctcctcgagcgttctcccttcgcaggctgcccccatccgccttctcgcggcgttctcccggttcttctctgtgtgcccgccgcggcggtccccttactggcgcggtctcgcttctgttcacgcctaggcgccgtggcccgccaccgcctttcccccgcccgccctgcggcatcgcgcgccccacccggcgccaggcctgtgcgcgaccctcgtcggcacgtgggacccgctgcctctccgcgtggggcgcgccggccctctcgcggcggcgccccctcgctgtccccacagctcgcggacctgcgcacgcgcccccctcgggcgcgcgccgcgtgccactgcgtcgcccgccggtcttctccccgcggcgctctgctctctcccggtggcctgcgcccc

SEQ ID NO: 301807 - DNA, 1301 bp, Homo sapiens
gctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301808 - DNA, 1138 bp, Homo sapiens
gctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301809 - DNA, 1947 bp, Homo sapiens
cgggttccagcgattctcctgcctcagtctcctgagtagctgggactacagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301810 - DNA, 1952 bp, Homo sapiens
  misc_feature (41)..(41): n is a, c, g, or t
taccgatcccccaaacgcagagaggaggacgaagaaaagcngagcaagggaacccaggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301811 - DNA, 2177 bp, Homo sapiens
  misc_feature (30)..(30): n is a, c, g, or t
accgtagtgttggtacaatatagaaccccnttttggtattttaaagagccagggctgtcggtcgaatctgggattgagtagcggcggtgtgtcaggggctaaagaggaggacgaagaaaagcagagcaagggaacccaggtaggtgcacccgagagtggggagacgcaggaggagccccgaacccggggcttctcggcgctccccgcgtactccgctctgcccccttctctccttccatttcctcccctcggtaattcgcgcctcccgcggctgtttccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301812 - DNA, 2110 bp, Homo sapiens
gctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgtgagtgcagcgggagggggcggtgccggcctggccccccgcctagccctggggttctgctgaggcctgcatccccctacaggcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301813 - DNA, 1941 bp, Homo sapiens
gagggtttgtaggctggcaggaaccagggttgtggctgagagtagggtctttggagagatggaaaaaaaagggaaagccctgtcaggacctgtaactgacctaacctaacccttcttagccccacaaggctctcaatcccctgtattctacaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301814 - DNA, 1901 bp, Homo sapiens
gctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301815 - DNA, 1737 bp, Homo sapiens
gctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactggggcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301816 - DNA, 1038 bp, Homo sapiens
  misc_feature (6)..(7): n is a, c, g, or t
  misc_feature (9)..(9): n is a, c, g, or t
cccgcnnanacaattaaggctaggtgcgaggctgggggtgaatcggccgagggatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301817 - DNA, 1216 bp, Homo sapiens
  misc_feature (163)..(163): n is a, c, g, or t
  misc_feature (230)..(230): n is a, c, g, or t
tctgggactgcctctgttgtgtgcctgctgaataacttctatcccggactcccggtgggaagtcgacttcccacgggagcagaaatggcaagggtggccaagcgtgcactggtttactgatcaaacctcacgtgacaggcccaggaaactctctccaggcctngtggcagcgtgaacacagttcacttggtggagtaggtttactcggaacatgcgtgtaggccagggcnttatgagtgaggccagcacttggaaggtgtcccacactgggtctttctgaagaaaacgtgtataccacccctgctccgcgtgggaagtgcgactttcccacgcgggaggaccacgatcgccctctctgaaggcatccacatatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301818 - DNA, 869 bp, Homo sapiens
gacagaaatgacaagaacgctgtaattactgctgtgttcccagccccagagactgtgggcagcgccagggtccaggatgtggggcacggtttcgggctgagggagtcacgggctgcctcccgccccgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301819 - DNA, 1225 bp, Homo sapiens
aagcttacggctaggtacgaggcctgggtggttaaaagcagagcaagggaacccacggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaaca

SEQ ID NO: 301820 - DNA, 3056 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaa

SEQ ID NO: 301821 - DNA, 405 bp, Homo sapiens
  misc_feature (48)..(49): n is a, c, g, or t
gaaaagtcatggaggccatggggttggcttgaaaccagcttggggggnncgatcctccctttttgtctagattttatgtatacgggtcttattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaa

SEQ ID NO: 301822 - DNA, 2890 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaa

SEQ ID NO: 301823 - DNA, 2538 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaa

SEQ ID NO: 301824 - DNA, 2704 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaa

SEQ ID NO: 301825 - DNA, 2859 bp, Homo sapiens
cgtctgaccgcctagccgaattttcccttacgatcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaa

SEQ ID NO: 301826 - DNA, 2671 bp, Homo sapiens
tacgtctaggtacgaggctgggtggagctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaa

SEQ ID NO: 301827 - DNA, 2566 bp, Homo sapiens
  misc_feature (2552)..(2552): n is a, c, g, or t
ggctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaaaaaaaaaaacaaanaaaaaaaaaaaaac

SEQ ID NO: 301828 - DNA, 2662 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaa

SEQ ID NO: 301829 - DNA, 2154 bp, Homo sapiens
  misc_feature (2140)..(2140): n is a, c, g, or t
ggctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcaaaaaaaaacaaanaaaaaaaaaaaaac

SEQ ID NO: 301830 - DNA, 2942 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaa

SEQ ID NO: 301831 - DNA, 2717 bp, Homo sapiens
gacatctggcaaagacagtctagatacagtcacatatcaacaagtggaagactgtgttttcccagggtagaagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaa

SEQ ID NO: 301832 - DNA, 2776 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaa

SEQ ID NO: 301833 - DNA, 2879 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggagtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaa

SEQ ID NO: 301834 - DNA, 2713 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggagtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaa

SEQ ID NO: 301835 - DNA, 2545 bp, Homo sapiens
cgaaagacatagctagtaggagcctgggtgtgtaatcggccgagggcagtcaaggaaattgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggagtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaa

SEQ ID NO: 301836 - DNA, 2599 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaagtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaa

SEQ ID NO: 301837 - DNA, 1572 bp, Homo sapiens
  misc_feature (1500)..(1500): n is a, c, g, or t
  misc_feature (1527)..(1527): n is a, c, g, or t
ggctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggccgaggcaggtggatcacgaggtcaggagatagagaccatcctggctaacatggtgaaaccccatctttattaaanatacaaaaaattagccaggcatggtgntgggtgcctgtagttccagctactcgggaggctgaggcaggagaa

SEQ ID NO: 301838 - DNA, 1521 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagacttttataactcaagtgaagtgacccaggcctggagcgccaagtacaaagcggggacgacacttgcacctcctggcaagccagagcacagtgaggttcaaaagaaggggctagtgaattaattcctcagttagatgtcctataattgcggtctgtagcaactaattcaaagcaaatctaattttca

SEQ ID NO: 301839 - DNA, 2067 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaa

SEQ ID NO: 301840 - DNA, 1967 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaa

SEQ ID NO: 301841 - DNA, 1368 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgacatgatggccaacgaattcggaaaggggacgcaatttgaattagttttaggccagcaccagacaagaaaggaagagcgcagctgtaaaaggctccagagcatggtttgaattttatacacctcttctgatggcacctccattaaggccggcgcgcggggggacaggggattgggtccccaattatagggttagaaataaggggaaccgggttaatttcag

SEQ ID NO: 301842 - DNA, 1013 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaatacagttgcttggaatgggca

SEQ ID NO: 301843 - DNA, 1244 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacaggtaaaacaaaaatgtatttagaaattacttttgcgaaatatgttgtactacttacaagtgctcaaaaaaactgaggggttgtatgtattaaattaagaattcaggtctgaagtatctaaattgcttcctttctgctttatagtggtttgggtttaagcaagttcccttatatccttcatttcttggaatgtccccttcacttctttgtcttaattgaaccttggcttttgctggagcttttgctctatagccctcaagtgaatgctttttttccccttgacaattagtgtattttaggaccaagaggatgaaagtttttactctctccctgctgccttgtctagatcagattttttttttttttgagacggagtttcgctcttgttgcctaggctggaggttgcagtgagcaaagatcatgctactgccctccagcttggatgacagagcgagactccatctt

SEQ ID NO: 301844 - DNA, 2114 bp, Homo sapiens
ggctgccgggatcgcgtctcagtccatcaggggggggagggggtggcgcgcgcgccatttctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactggtatgtgataattatccactgtcttagcaagtcactatttgaggaaataaactttaattcaaaaatgtttgtagttaacattattttgatttcttcagttgttgcttggaatgtttttatactgaccaagttggtatgtgacgtttatttttctctgactataaaagtaaaaaagaactgaaaatacccaaaaagtaatgttttatagaaagtctcccattgatttaagaagttatctattagattgatatcagaagtttcatatgagtatttggcttatgcatttctgtcttttggttttaggcaaaaggatgtcaattcttgatgttaaactttaggattcttaaagtataatgaagactggaatgggctgtggggaacataatagtggatgacagtgacttaggattcaattcagaaaatagttgtgaatctgttttattttggttacagcctactcatacgatttatttcatattttctaagtgtatttttgttcttcctgtatgtttcttggcccttgagtcttctctgtctttaatctttctctcctctcctactatttatagccagtctcatattaatttcctttctctagggcctttaaccacttggtgctcatttcagaccagtagtagtagcaacaaagttctgcaaatcaaatgtatcttcactcctgctgtatttaagacacagctatctcagtatcttaaaataacaatgtaattattttttggcatacccttgcctgacttctgaggacctcactaagtctagttctagcctttgtagaatggtcaacttctttcatcaaggctttggtttcattactggtgtctgaattagttccactcctagcttgacccagattttagtttttattatggattttttcttcaaacttgtttatttaatattaagttttcatttttggcagcatatggatgattttatttttaataatcatatctcttagtaaactaatggttaaataatattaaagtataagaagctaaaattggccaggtgtggtggctcacgcctgtaatcccagcactttgggaggctgaggcaggcagatcacctgaggtcaggagttcaagatcagcctggccaacgtggtgaaacccctgtctttactaaaaatacaaaaattagctgggcgtggtggcgcacgcctgtagtcccagctacttgggaggctgaggcaggagaatcacttcaacccaggaggtggaggttgcagtgagcaaagatcatgctactgccctccagcttggatgacagagcgagactccatctt

SEQ ID NO: 301845 - DNA, 568 bp, Homo sapiens
tttttttttttgagacggagtttcgctcttgttgcctaggctggagtgcaatggtacgatctcggctcactgcaacctccgcctccttggttcaagcaattctcctgcctcagcctcccgagtagctgggactagcatgtgccaccacgcctggctaattttgtatttttagtagagacggggtttctctatgttggtcaggctagtctagaactcccgacctctggtgatcctcccgcctcggcctcccaaagtgctgggattacaggcgtgagccacagtgcctggctgatcagatttttttaaatatccaattctaaatccatggaattgattgagaagtagattttatatcacagttctatacacatttatatataactgaaacaatttaacaaaactgtacttttatttattatacatgatttattttgatatttcttattctatttcattttttaaaatgccaattgtgatctaatactacctatgatttaaaaacactgcgttagaccgctgcctccccttgtaaaaaccactgtttctttacatttttatcatccagaca

SEQ ID NO: 301846 - DNA, 2572 bp, Homo sapiens
accggaagcgctctagggaaccctggagcttccgcgcctgcccagttttgctccgaaagacttaccgaggagggagcttgcggtgcgttctgggaaagttgctgggccagctcctttgtttccagtctgagcgttgcgttcggtttcccgagggtcttctgaggcaccgcggctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcagaatctggcgcgtctggcccagcggatagacttcagccagggttcgggctccgaggaggaggaggcggcggggaccgagggggacgcgcaggactggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacagaatcctcagacgttgcaattgatatctaaaaagaagtcacttgctggagcagcacaaatcttattgaagggggcagaaagactgactaaatcagttaccgaaaaccaagaaaacaagctacaaagagacttcaattctgagcttttgcgattacggcaacactggaaacttcgaaaagttggagataaaattctcggagatctgagctacagaagtgcaggatctctctttcctcatcatggtacatttgaagtaataaagaatacagatctcgatctggataaaaagatacctgaagattactgtcctcttgatgtccaaattcctagtgatttagaggggtctgcatatatcaaggtttcaatacaaaaacaggctccagatataggtgacctcggcacagttaacctcttcaaacgacctttgcccaaatccaaaccaggttccccacattggcagacaaaattagaagcggcacagaatgttctcttatgtaaagaaatttttgcacagctctctcgggaagctgttcaaattaaatcacaagtccctcacattgtggtgaaaaaccagattatctctcagccctttccgagcttgcagttatctatttctttgtgccattcctcaaatgataagaaatcccaaaaatttgctactgagaagcaatgtccggaggaccacctttatgtcctagagcataatttgcatctactgattagagagtttcataaacagaccttgagttccatcatgatgcctcatccagcaagtgcaccttttggccacaagagaatgagactttcgggtcctcaagcttttgataaaaatgaaattaattcattacagtccagtgaagggcttctggaaaaaataattaaacaagcaaagcatatttttctaaggagtagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtccattcaactgcaattgaatattggagttgagcagattcgagttgtacatagagatggaagagtaattacactgtcttatcaggagcaggagctacaggattttcttctgtctcagatgtcacagcaccaggtacatgcagttcagcaactcgccaaggttatgggctggcaagtactgagcttcagtaatcatgtgggacttggacctatagagagcattggtaatgcatctgccatcacggtggcctccccaagtggtgactatgctatttcagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaa

SEQ ID NO: 301847 - DNA, 2326 bp, Homo sapiens
accggaagcgctctagggaaccctggagcttccgcgcctgcccagttttgctccgaaagacttaccgaggagggagcttgcggtgcgttctgggaaagttgctgggccagctcctttgtttccagtctgagcgttgcgttcggtttcccgagggtcttctgaggcaccgcggctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcagaatctggcgcgtctggcccagcggatagacttcagccagggttcgggctccgaggaggaggaggcggcggggaccgagggggacgcgcaggactggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacaggtatttgtggactttaattgaataataaaattttatttattaaatcccaggacccttttttggctttgtgcttgttgttccattttcctttcttgcaaaattaagtccagatgaagatttaaagactaactggtctaaaacaaagccatacaactgcatttcctttatttttttattatatacctatgatccttggaagagttaagtttcattaagaatgtaatacctttaaggccaggcgtggtggctcacgcctgtaatcccagcactttgggaggccaaggcgggcagatcacgaggtcaggagatcgagaccatcctggctaatgctgtgaaaccttgtctctattaaaaataacaaaaataagccaggcgtggtggtgggcacctgtagtcccagctactcagaaggctgaggcaggagaattgcttgagcctgggaggcgggggttgcagtgagctgagatcgcgccactgcactccagcctgggcgacagagcgagattccatcccaaaaaaaaaaaaaaaaagaatgtaatactttaaaggttaccaaatcttaacaaattcttatagcctgggtccttggtctgtgatatattacacaaaaatgtgatgatataatggctttggaatcaggtagacctggattcgaatcctgcctctgccttcattaactgtgtgaccttaaattaagcaagttattttctcttaagtccctgtttttccatctaatccttccttccctttttttttaagggatggattagaaaagttaggcgaaattatggagcatattgagagctgggtagaattgctgctatttcataaacagtgtattcaatttttgaacatttgaagatgaaagagaagtagcaggaagatgagttggtgaatagtctgaaatcattgaggctacttgggtccttaaggaaaacaagtgtcaagaccataaccaaattagtcatggagaagaagtaatgactgttagaacccatttgtaaataaaattaattgaatagaattactcacatagtaatagtttcagaatctagaaacattgtgctgggggactaatagagttccctaaatctgcattcttcattttatagagagaaaactaaagcttaaagagatttgtaatatgttcaagttgctgtcaagccagtagttagggagccaagactagaactccagcacctaactcatagccccactgccttttctactattctgtgcttttcccagaagggagtctccaggaatttcttaatatctccaggaactcttttatttacgttccctaatgcaatcaaaagattattttgatatgtttatgaagctttttatgtgatttttgactctcatacagccagaaaactgtattaaactggttagtaaaatacacaaattatggtgattgtggatatttatatatgcatatgtgatacatagatagtgacttctgatcagttttccaaaaaattaggattcagtgaagtacatttaatattaacaatggcagggcacggtggcttatgcctgtaattccaacactttggggaaccaaagcaggaagccaggagtttgagactttcccaggcaacatagcaagaccctgtctctaccaaaaa

SEQ ID NO: 301848 - DNA, 3786 bp, Homo sapiens
accggaagcgctctagggaaccctggagcttccgcgcctgcccagttttgctccgaaagacttaccgaggagggagcttgcggtgcgttctgggaaagttgctgggccagctcctttgtttccagtctgagcgttgcgttcggtttcccgagggtcttctgaggcaccgcggctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcagaatctggcgcgtctggcccagcggatagacttcagccagggttcgggctccgaggaggaggaggcggcggggaccgagggggacgcgcaggactggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacagaatcctcagacgttgcaattgatatctaaaaagaagtcacttgctggagcagcacaaatcttattgaagggggcagaaagactgactaaatcagttaccgaaaaccaagaaaacaagctacaaagagacttcaattctgagcttttgcgattacggcaacactggaaacttcgaaaagttggagataaaattctcggagatctgagctacagaagtgcaggatctctctttcctcatcatggtacatttgaagtaataaagaatacagatctcgatctggataaaaagatacctgaagattactgtcctcttgatgtccaaattcctagtgatttagaggggtctgcatatatcaaggtttcaatacaaaaacaggctccagatataggtgacctcggcacagttaacctcttcaaacgacctttgcccaaatccaaaccaggttccccacattggcagacaaaattagaagcggcacagaatgttctcttatgtaaagaaatttttgcacagctctctcgggaagctgttcaaattaaatcacaagtccctcacattgtggtgaaaaaccagattatctctcagccctttccgagcttgcagttatctatttctttgtgccattcctcaaatgataagaaatcccaaaaatttgctactgagaagcaatgtccggaggaccacctttatgtcctagagcataatttgcatctactgattagagagtttcataaacagaccttgagttccatcatgatgcctcatccagcaagtgcaccttttggccacaagagaatgagactttcgggtcctcaagcttttgataaaaatgaaattaattcattacagtccagtgaagggcttctggaaaaaataattaaacaagcaaagcatatttttctaaggagtagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtccattcaactgcaattgaatattggagttgagcagattcgagttgtacatagagatggaagagtaattacactgtcttatcaggagcaggagctacaggattttcttctgtctcagatgtcacagcaccaggtacatgcagttcagcaactcgccaaggttatgggctggcaagtactgagcttcagtaatcatgtgggacttggacctatagagagcattggtaatgcatctgccatcacggtggcctccccaagtggtgactatgctatttcagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaatctccaaatacctttttttccccccaaatactttctaaactttttttttttgagatggtatctcactctgtagcccagtctggagtgcagtggtgtgatcatggttcactgcagtcttgacctcccaggcttaggtgatccttctgtctcagccttccgagtagctgggaccacaggcatgcacaaccacgcctggctaatttttgtattttttataaagacagggtttttccatgttgcccaggctggtttcgaactcggctcaagtgatctacctgcctctgcctcccaaagtgctaggattacaggcgtgagccaccatgcccagcctactctaaattattgataacctcttcctccagttgtctcctttaagctttcctgggtctaacctacataggtaatttaagaacatcctcagaaaggacagctgaaggcaataggaggcagattatctctttagggcgtcctcaagtttttttggtctgttctcccacttgattgacctcaccagttgagacacctagtgtatggctcatgcccagccttccacctgggattctccagcctccacccagcagccctggattgctttctccaattaaggcctttccatcagctctctgctttttcaaagcgaaaaaactaatggattagtgggttatcttttccaaggaacaggtttgcacttcttggaaaaagtgcctaaagtgtgcccattaatatgaggatagatttaggctcataagccttttggtaacactgaaagtagtatcatataggcaagctctccttataagtaaggctttcaatttttaaaacagacatcctgctttaacaatttgtaagatgactgtgcagtaataaaagtcctttgtatttcaaaaaaaaaaaaaaaaaaaaaaaaaaaaaaaaaaaaaaaaaaaaaaaaaaaaaaaaacaacaacacaacaacaacaagagggggcggggcgctccaaaataatacccccccgaggggggcaccaacggctatgactgaccagccacacgttgttgtaaaaaaaacgcggcccccacagtagagcgacgtacgattaaaaaacacaggcgaagccggcgccgggtttaaaacacacgcacgtgatgggagaaacaaacacctctggacaccctggggaagcaacaccaccactatgcggggggagaaaaatatagaggccaccacactcgag

SEQ ID NO: 301849 - DNA, 3598 bp, Homo sapiens
accggaagcgctctagggaaccctggagcttccgcgcctgcccagttttgctccgaaagacttaccgaggagggagcttgcggtgcgttctgggaaagttgctgggccagctcctttgtttccagtctgagcgttgcgttcggtttcccgagggtcttctgaggcaccgcggctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcagaatctggcgcgtctggcccagcggatagacttcagccagggttcgggctccgaggaggaggaggcggcggggaccgagggggacgcgcaggactggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacagaatcctcagacgttgcaattgatatctaaaaagaagtcacttgctggagcagcacaaatcttattgaagggggcagaaagactgactaaatcagttaccgaaaaccaagaaaacaagctacaaagagacttcaattctgagcttttgcgattacggcaacactggaaacttcgaaaagttggagataaaattctcggagatctgagctacagaagtgcaggatctctctttcctcatcatggtacatttgaagtaataaagaatacagatctcgatctggataaaaagatacctgaagattactgtcctcttgatgtccaaattcctagtgatttagaggggtctgcatatatcaaggtttcaatacaaaaacaggctccagatataggtgacctcggcacagttaacctcttcaaacgacctttgcccaaatccaaaccaggttccccacattggcagacaaaattagaagcggcacagaatgttctcttatgtaaagaaatttttgcacagctctctcgggaagctgttcaaattaaatcacaagtccctcacattgtggtgaaaaaccagattatctctcagccctttccgagcttgcagttatctatttctttgtgccattcctcaaatgataagaaatcccaaaaatttgctactgagaagcaatgtccggaggaccacctttatgtcctagagcataatttgcatctactgattagagagtttcataaacagaccttgagttccatcatgatgcctcatccagcaagtgcaccttttggccacaagagaatgagactttcgggtcctcaagcttttgataaaaatgaaattaattcattacagtccagtgaagggcttctggaaaaaataattaaacaagcaaagcatatttttctaaggagtagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtccattcaactgcaattgaatattggagttgagcagattcgagttgtacatagagatggaagagtaattacactgtcttatcaggagcaggagctacaggattttcttctgtctcagatgtcacagcaccaggtacatgcagttcagcaactcgccaaggttatgggctggcaagtactgagcttcagtaatcatgtgggacttggacctatagagagcattggtaatgcatctgccatcacggtggcctccccaagtggtgactatgctatttcagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaatctccaaatacctttttttccccccaaatactttctaaactttttttttttgagatggtatctcactctgtagcccagtctggagtgcagtggtgtgatcatggttcactgcagtcttgacctcccaggcttaggtgatccttctgtctcagccttccgagtagctgggaccacaggcatgcacaaccacgcctggctaatttttgtattttttataaagacagggtttttccatgttgcccaggctggtttcgaactcggctcaagtgatctacctgcctctgcctcccaaagtgctaggattacaggcgtgagccaccatgcccagcctactctaaattattgataacctcttcctccagttgtctcctttaagctttcctgggtctaacctacataggtaatttaagaacatcctcagaaaggacagctgaaggcaataggaggcagattatctctttagggcgtcctcaagtttttttggtctgttctcccacttgattgacctcaccagttgagacacctagtgtatggctcatgcccagccttccacctgggattctccagcctccacccagcagccctggattgctttctccaattaaggcctttccatcagctctctgctttttcaaagcgaaaaaactaatggattagtgggttatcttttccaaggaacaggtttgcacttcttggaaaaagtgcctaaagtgtgcccattaatatgaggatagatttaggctcataagccttttggtaacactgaaagtagtatcatataggcaagctctccttataagtaaggctttcaatttttaaaacagacatcctgctttaacaatttgtaagatgactgtgcagtaataaaagtcctttgtatttctccaccgtgttttcattaaagaaaaatggagcttgtgggccacgatagaacaactttgtgcttttttccccttctgatcaagatcttgcatctttctatccatggaaattaaaataattggtatgaatttgcagttatttaaa

SEQ ID NO: 301850 - DNA, 2797 bp, Homo sapiens
  misc_feature (2576)..(2576): n is a, c, g, or t
accggaagcgctctagggaaccctggagcttccgcgcctgcccagttttgctccgaaagacttaccgaggagggagcttgcggtgcgttctgggaaagttgctgggccagctcctttgtttccagtctgagcgttgcgttcggtttcccgagggtcttctgaggcaccgcggctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcagaatctggcgcgtctggcccagcggatagacttcagccagggttcgggctccgaggaggaggaggcggcggggaccgagggggacgcgcaggactggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacagaatcctcagacgttgcaattgatatctaaaaagaagtcacttgctggagcagcacaaatcttattgaagggggcagaaagactgactaaatcagttaccgaaaaccaagaaaacaagctacaaagagacttcaattctgagcttttgcgattacggcaacactggaaacttcgaaaagttggagataaaattctcggagatctgagctacagaagtgcaggatctctctttcctcatcatggtacatttgaagtaataaagaatacagatctcgatctggataaaaagatacctgaagattactgtcctcttgatgtccaaattcctagtgatttagaggggtctgcatatatcaaggtttcaatacaaaaacaggctccagatataggtgacctcggcacagttaacctcttcaaacgacctttgcccaaatccaaaccaggttccccacattggcagacaaaattagaagcggcacagaatgttctcttatgtaaagaaatttttgcacagctctctcgggaagctgttcaaattaaatcacaagtccctcacattgtggtgaaaaaccagattatctctcagccctttccgagcttgcagttatctatttctttgtgccattcctcaaatgataagaaatcccaaaaatttgctactgagaagcaatgtccggaggaccacctttatgtcctagagcataatttgcatctactgattagagagtttcataaacagaccttgagttccatcatgatgcctcatccagcaagtgcaccttttggccacaagagaatgagactttcgggtcctcaagcttttgataaaaatgaaattaattcattacagtccagtgaagggcttctggaaaaaataattaaacaagcaaagcatatttttctaaggagtagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtccattcaactgcaattgaatattggagttgagcagattcgagttgtacatagagatggaagagtaattacactgtcttatcaggagcaggagctacaggattttcttctgtctcagatgtcacagcaccaggtacatgcagttcagcaactcgccaaggttatgggctggcaagtactgagcttcagtaatcatgtgggacttggacctatagagagcattggtaatgcatctgccatcacggtggcctccccaagtggtgactatgctatttcagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaaaaanagaatctgatgtgttttcctctaaccgctcctggagtctagtctcgctcggattttcggcatacgctttggccttctcccaacttatttgcgcccatgttctctcctccctccctacggcgggcggcagcccctgcgcccgcccctccctgataaggattatccgtccctcacccccctgtttggcgacttgtggccccgcggatccccctcctctcaccc

SEQ ID NO: 301851 - DNA, 1632 bp, Homo sapiens
ccaggctagagtgcaatggcgcagtctcggctcaccgcaacgtctacctcccaggttcaagcgattctcctgcctcagcctcccgagtagctgggattacaggcatgcgccaccattcctggctaattttgtatttttagtagagatggggtttctccatgttggtcaggctggtctcgaacacccaacctcaggttccccacattggcagacaaaattagaagcggcacagaatgttctcttatgtaaagaaatttttgcacagctctctcgggaagctgttcaaattaaatcacaagtccctcacattgtggtgaaaaaccagattatctctcagccctttccgagcttgcagttatctatttctttgtgccattcctcaaatgataagaaatcccaaaaatttgctactgagaagcaatgtccggaggaccacctttatgtcctagagcataatttgcatctactgattagagagtttcataaacagaccttgagttccatcatgatgcctcatccagcaagtgcaccttttggccacaagagaatgagactttcgggtcctcaagcttttgataaaaatgaaattaattcattacagtccagtgaagggcttctggaaaaaataattaaacaagcaaagcatatttttctaaggagtagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtccattcaactgcaattgaatattggagttgagcagattcgagttgtacatagagatggaagagtaattacactgtcttatcaggagcaggagctacaggattttcttctgtctcagatgtcacagcaccaggtacatgcagttcagcaactcgccaaggttatgggctggcaagtactgagcttcagtaatcatgtgggacttggacctatagagagcattggtaatgcatctgccatcacggtggcctccccaagtggtgactatgctatttcagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaa

SEQ ID NO: 301852 - DNA, 1412 bp, Homo sapiens
  misc_feature (23)..(23): n is a, c, g, or t
  misc_feature (72)..(72): n is a, c, g, or t
attggaacgatacagagaagatnagcatggcccctgcgcaaggatgacacgcaaattcgtgaagcgttccanatttctttccatatttcaggttatttacatatgtcctccttctttttataaataggcttgcagttatctatttctttgtgccattcctcaaatgataagaaatcccaaaaatttgctactgagaagcaatgtccggaggaccacctttatgtcctagagcataatttgcatctactgattagagagtttcataaacagaccttgagttccatcatgatgcctcatccagcaagtgcaccttttggccacaagagaatgagactttcgggtcctcaagcttttgataaaaatgaaattaattcattacagtccagtgaagggcttctggaaaaaataattaaacaagcaaagcatatttttctaaggagtagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtccattcaactgcaattgaatattggagttgagcagattcgagttgtacatagagatggaagagtaattacactgtcttatcaggagcaggagctacaggattttcttctgtctcagatgtcacagcaccaggtacatgcagttcagcaactcgccaaggttatgggctggcaagtactgagcttcagtaatcatgtgggacttggacctatagagagcattggtaatgcatctgccatcacggtggcctccccaagtggtgactatgctatttcagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaa

SEQ ID NO: 301853 - DNA, 1463 bp, Homo sapiens
ggagtataaggatttgattgtgcaaaaaatctctagcttctcttgaatatgattataatttcattacagtaatgggtctagatgtgggtgtgtcccaagtcatttgttaccagggatcaagtactgacatttatgaatgatttatattaggtttataccgtagaatatcgaatatccttctcactcatttcctgataagcttttctgagtggaagaaaatgaatagagttaaagggaataaacccatcatgaatcatgataatcaggggtgtgtgatgagagtgtattgtaatgtcaagctgagaacctacacattcaagcagtatgaaagggttcttagagctacctctgcctttatttaaagtctgcctacacatagtggtagtttaaaaaagtagttagttttaaaattttcataaaattttcgaatcatttatattcctatcattttgtatggtgacttaaaaagttttttaacttcttgtatttaaaagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtccattcaactgcaattgaatattggagttgagcagattcgagttgtacatagagatggaagagtaattacactgtcttatcaggagcaggagctacaggattttcttctgtctcagatgtcacagcaccaggtacatgcagttcagcaactcgccaaggttatgggctggcaagtactgagcttcagtaatcatgtgggacttggacctatagagagcattggtaatgcatctgccatcacggtggcctccccaagtggtgactatgctatttcagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaa

SEQ ID NO: 301854 - DNA, 854 bp, Homo sapiens
caggaggattcctcagacctaagatagggttgctgtagtagtcagtgagcaccccaacaaaagtttacttcatggtcgtgatgttaagtcactgcagatatctctgctgactgtcagtcaagtgtcctttttcattcacagatgtcacagcaccaggtacatgcagttcagcaactcgccaaggttatgggctggcaagtactgagcttcagtaatcatgtgggacttggacctatagagagcattggtaatgcatctgccatcacggtggcctccccaagtggtgactatgctatttcagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaa

SEQ ID NO: 301855 - DNA, 1108 bp, Homo sapiens
gccgaggcaggaagatcatctgaggttaggagtttgagaccagcctggccaacatggcaaaaccccgtctctactaaaaatacaaaaattagctgggtatgacgatgggcacctgtaatcccagcactttggggggctgaggtgggaggattgcttgagcccaggagtttgagaccagccctggcaacatagagagaccttgtctttaaccgcctcccaaaaaaagctttgtgtttttcagtgctgcatgtggaaacaaacaaaaagatgatttcctgaaattatagaggacatttgacattcctaggtcaaaactcaccttgcttaatctttgtggtacaaataataattcatgaatatttataccatcctcttatatagaagttagagtttttctcttgcatgttgaaactgaaaaagcactttttttacaagaatatttaagttggtagacaaagtttttgtattcacagtagaatggagttgtgggatttatccttgttatttctagtttggtaaactagagtgtattgatattttggtttttctccacagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaa

SEQ ID NO: 301856 - DNA, 1131 bp, Homo sapiens
cgtctgtaatcccagcactttcggaggccggggcaggcagatcacgaggtcaggagatcaagaccatcctgactaacatggtgaaaccccgtctctactaaaaatacaaaaaattagctgggcgtggtggtggacctgtaatcccagcactttggggggctgaggtgggaggattgcttgagcccaggagtttgagaccagccctggcaacatagagagaccttgtctttaaccgcctcccaaaaaaagctttgtgtttttcagtgctgcatgtggaaacaaacaaaaagatgatttcctgaaattatagaggacatttgacattcctaggtcaaaactcaccttgcttaatctttgtggtacaaataataattcatgaatatttataccatcctcttatatagaagttagagtttttctcttgcatgttgaaactgaaaaagcactttttttacaagaatatttaagttggtagacaaagtttttgtattcacagtagaatggagttgtgggatttatccttgttatttctagtttggtaaactagagtgtattgatattttggtttttctccacagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaa

SEQ ID NO: 301857 - DNA, 333 bp, Homo sapiens
tcgccaaggttatgggctggcaagtactgagcttcagtaatcatgtgggacttggacctatagagagcattggtaatgcatctgccatcacggtggcctccccaagtggtgactatgctatttcaggtactttctgctgctttgaatgagaagggaccattgggagtttggctttaacatttagttttaataattaaatatgggtaagagtaatttatctctgcaataaattagttaatgttgtatttacaccgaatgtttatttgatcatagctattatgcagagcaagagattattatttctctttctagtaattataataaatgtttaga

SEQ ID NO: 301858 - DNA, 608 bp, Homo sapiens
tagagactgaataggaaaaaaaagaatataccgtaatgtagtgttttcctaaacttttgtcatatgtattcagatcaccatttaaactagttaatgcataatatggttagataattgatacatatatttcttgtctttcaggttccccacattggcagacaaaattagaagcggcacagaatgttctcttatgtaaagaaatttttgcacagctctctcgggaagctgttcaaattaaatcacaagtccctcacattgtggtgaaaaaccagattatctctcagccctttccgagtaagagcagccctttttcgactttatgaacaggactttgtgttttgggggactaggacagagaaggtagctcttagggtgtattgggagaataatgagagcaaagaaatagtgtgctatccatagtgacagccagtaaagcatgtaacacaaactatactgtggaatctgttctgtcctaaatagtgtgacccttggatttttaagctacatattaaaaatttgcacttatgtagtcattattgtggtcaagagaaaagaaaatttgcactagcatagctatagttatttagcaacagttgctttgagggaga

SEQ ID NO: 301859 - DNA, 687 bp, Homo sapiens
tagtgtaaaataaaatcgagcaatacagtcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattg

SEQ ID NO: 301860 - DNA, 354 bp, Homo sapiens
accgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgagtatgaattatatgtagccagagatgtcaataaggcttactgtcggtaggtaatatggttagtttgtagggaaaaga

SEQ ID NO: 301861 - DNA, 1132 bp, Homo sapiens
cagccctgctgagcgaccccgccagtcgggtccatcctgcagtaaatgcacaacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaca

SEQ ID NO: 301862 - DNA, 521 bp, Homo sapiens
gtatacatcgatatgctcctacattttaaataaaaaaaaaaaaaaggcttattaggaacgtccagttgccgtccgggtttggacggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaca

SEQ ID NO: 301863 - DNA, 401 bp, Homo sapiens
agtgggccacttttggtaagcagtaaatgcacaacccggacggaagtgcctctcctccagcacgaggtggggtgtgcacaggcaaagctcaggcagctggaggccctgctgagctccctgcccccaccccaaagccagaaggaggcccaagttgcagcccgggtttggagggagtttgagatgaagcgaatgctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaca

SEQ ID NO: 301864 - DNA, 341 bp, Homo sapiens
  misc_feature (38)..(38): n is a, c, g, or t
gagggatagagtgggaaggtaagagaccacggagcagnagacctacaggcagcccagttgcacttgggtttggacggagtttgagatgaagcgaatgctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacacaaagaagaaaaaatgaatggccttctttggcctcat

SEQ ID NO: 301865 - DNA, 1256 bp, Homo sapiens
cagccctgctgagcgaccccgccagtcgggtccatcctgcagtaaatgcacaacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccggtgagcctgaccgggagggggtccccaggccgggcctctaggcaaaagatttagcccctccagtttgagggactccggtttcccgacaccccgatttaactccagaccacgattcctgtggcagctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaca

SEQ ID NO: 301866 - DNA, 1304 bp, Homo sapiens
ggacgtcgctgcggaccaatcgcgtgcgtctatgcaaatagcggtcgttctggggaactctgctcccgcggggtgagagttggccgctcttcggccgagctgcccgcgcgtcctttctccgtgcgcgtcgtcaggcgtgtcctctccgcgtgtccacccacagccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccggtgagcctgaccgggagggggtccccaggccgggcctctaggcaaaagatttagcccctccagtttgagggactccggtttcccgacaccccgatttaactccagaccacgattcctgtggcagctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaca

SEQ ID NO: 301867 - DNA, 1169 bp, Homo sapiens
cagccctgctgagcgaccccgccagtcgggtccatcctgcagtaaatgcacaacccggacggaagtgcctctccgacagcagatccaggctcggagctccagacgctgggacaggtgacccggggcggtagcgagccggacggccttgcaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaca

SEQ ID NO: 301868 - DNA, 1504 bp, Homo sapiens
cagccctgctgagcgaccccgccagtcgggtccatcctgcagtaaatgcacaacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggcgggagtgcagtggtatgatctcagctcactgcaacctcagcgtcccgggttcaagcggttctcctgcctcagctgggatcacaggcgcccaccaccgtgcctggcaaatttttgtatttgtagtagagatggggtttcaccatgttggccaggctggtctcgaactcctgacctcaagtgatccgcccacctcggcctcccagactgctgggattacaggcatgagccaccttgcccggctcacccggtcgcctgtgcccagtttcaaggagagaaaattgaggctcggagaatgaaaggcagagagttaagcagcttgaaggccacagggcagactgctgcaaagacttccgggtctcgccctgcctaggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaca

SEQ ID NO: 301869 - DNA, 1749 bp, Homo sapiens
cagccctgctgagcgaccccgccagtcgggtccatcctgcagtaaatgcacaacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccggtgagcctgaccgggagggggtccccaggccgggcctctaggcaaaagatttagcccctccagtttgagggactccggtttcccgacaccccgatttaactccagaccacgattcctgtggcagctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggtgagtcttgcatcccacagcttggtcttgcacccctgagacttctgtgaggctggggtgcctgtgcccagtttcttttttttttctttcttttgagacagaatctcgctctgtcacccaggcgggagtgcagtggtatgatctcagctcactgcaacctcagcgtcccgggttcaagcggttctcctgcctcagctgggatcacaggcgcccaccaccgtgcctggcaaatttttgtatttgtagtagagatggggtttcaccatgttggccaggctggtctcgaactcctgacctcaagtgatccgcccacctcggcctcccagactgctgggattacaggcatgagccaccttgcccggctcacccggtcgcctgtgcccagtttcaaggagagaaaattgaggctcggagaatgaaaggcagagagttaagcagcttgaaggccacagggcagactgctgcaaagacttccgggtctcgccctgcctaggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaca

SEQ ID NO: 301870 - DNA, 1292 bp, Homo sapiens
cagccctgctgagcgaccccgccagtcgggtccatcctgcagtaaatgcacaacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccggtgagcctgaccgggagggggtccccaggccgggcctctaggcaaaagatttagcccctccagtttgagggactccggtttcccgacaccccgatttaactccagaccacgattcctgtggcagctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacacaaaaaaaaactaaaattggctcgttggcctctcgggg

SEQ ID NO: 301871 - DNA, 926 bp, Homo sapiens
cagccctgctgagcgaccccgccagtcgggtccatcctgcagtaaatgcacaacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatgctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaca

SEQ ID NO: 301872 - DNA, 1631 bp, Homo sapiens
ggacgtcgctgcggaccaatcgcgtgcgtctatgcaaatagcggtcgttctggggaactctgctcccgcggggtgagagttggccgctcttcggccgagctgcccgcgcgtcctttctccgtgcgcgtcgtcaggcgtgtcctctccgcgtgtccacccacagccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccggtgagcctgaccgggagggggtccccaggccgggcctctaggcaaaagatttagcccctccagtttgagggactccggtttcccgacaccccgatttaactccagaccacgattcctgtggcagctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagctaaggaggcccaagttgcagcccgggtttggagggagtttgagatgaagcgaatggtgagtcttgcatcccacagcttggtcttgcacccctgagacttctgtgaggctggggtgcctgtgcccagtttcttttttttttctttcttttgagacagaatctcgctctgtcacccaggcgggagtgcagtggtatgatctcagctcactgcaacctcagcgtcccgggttcaagcggttctcctgcctcagctgggatcacaggcgcccaccaccgtgcctggcaaatttttgtatttgtagtagagatggggtttcaccatgttggccaggctggtctcgaactcctgacctcaagtgatccgcccacctcggcctcccagactgctgggattacaggcatgagccaccttgcccggctcacccggtcgcctgtgcccagtttcaaggagagaaaattgaggctcggagaatgaaaggcagagagttaagcagcttgaaggccacagggcagactgctgcaaagacttccgggtctcgccctgcctaggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaca

SEQ ID NO: 301873 - DNA, 1044 bp, Homo sapiens
cagccctgctgagcgaccccgccagtcgggtccatcctgcagtaaatgcacaacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtactctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaca

SEQ ID NO: 301874 - DNA, 1014 bp, Homo sapiens
cagccctgctgagcgaccccgccagtcgggtccatcctgcagtaaatgcacaacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatgtctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaca

SEQ ID NO: 301875 - DNA, 961 bp, Homo sapiens
cagccctgctgagcgaccccgccagtcgggtccatcctgcagtaaatgcacaacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatgctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacacaaaaaaaaccaaaaaaatggctctcgttggcctcat

SEQ ID NO: 301876 - DNA, 932 bp, Homo sapiens
ggacgtcgctgcggaccaatcgcgtgcgtctatgcaaatagcggtcgttctggggaactctgctcccgcggggtgagagttggccgctcttcggccgagctgcccgcgcgtcctttctccgtgcgcgtcgtcaggcgtgtcctctccgcgtgtccacccacagccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccggtgagcctgaccgggagggggtccccaggccgggcctctaggcaaaagatttagcccctccagtttgagggactccggtttcccgacaccccgatttaactccagaccacgattcctgtggcagctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagctaaggaggcccaagttgcagcccgggtttggagggagtttgagatgaagcgaatgctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaca

SEQ ID NO: 301877 - DNA, 308 bp, Homo sapiens
  misc_feature (7)..(7): n is a, c, g, or t
  misc_feature (94)..(94): n is a, c, g, or t
  misc_feature (99)..(99): n is a, c, g, or t
  misc_feature (103)..(103): n is a, c, g, or t
  misc_feature (106)..(106): n is a, c, g, or t
gcacganctgtgttgtgtgtgcaccttctccgtgcttttcactatttaacaccatgatcatgtggaatacattagaaaggaaataggtcaaaanccatnatgnganccatctaatgtattccacatgatcatggtgttaaatagtgaaaagtactgtgttgtgtgtgcaccttctccgtgcatttattagactaaccagtcaagcagacagctcagttagggagaaaacaatactctgaaatttgaaggccaatctgttgttactaagctgtttatctctattgcctttttaaatgtctggataagtt

SEQ ID NO: 301878 - DNA, 3150 bp, Homo sapiens
ggcacgagggcagggagtgcgggtcggttctgcgtgcgctgccggacgaggctcccgccgccgattgacccgcgctccgcccgtagtcgggccgttctgttccaagagataaccattgggaccttggtagctaatgtccgaagaaagtgactctctgagaaccagcccttctgtggcctcactctctgaaaatgagctgccaccaccacctgagcctccgggctatgtgtgctcactgacagaagacctggtcaccaaagcccgggaagagctgcaggaaaagccggaatggagacttcgagatgtgcaggcccttcgtgacatggtgcggaaggagtaccccaacctgagcacatccctcgacgatgccttcctgctgcgcttcctccgagcccgcaagtttgattacgaccgggccctgcagctcctcgtcaactaccacagctgtagaagaagctggcccgaagtcttcaataacttgaagccatcagccttaaaagatgtccttgcttccgggttcctcaccgtgctgccccacactgaccccaggggctgccatgtcgtctgcatccgcccagacagatggataccaagcaactatccaattactgaaaacatccgagccatatacttgaccttagaaaaactcattcagtctgaagaaacccaggtgaatggaattgtaattcttgcagactacaaaggagtgagtttatcaaaagcatctcactttggcccttttatagccaaaaaggtgattggcatcctccaggatggtttccccattcggataaaagcagtccatgtggtgaatgaacctcgaatatttaaaggcatttttgccatcataaaaccatttctaaaggagaaaatagcaaacagattcttcctccatgggtctgacttgaactctctccacacaaaccttccaagaagcatcctccccaaggagtatgggggcacggctggggagctggacactgccacctggaacgcggtactgctggcttcagaagacgattttgtgaaagagttctgccaacctgttcctgcctgtgacagcatcctgggccagacgctgctgcccgagggcctgacctcagatgcacagtgtgacgactccttgcgagctgtgaagtcacagctgtactcctgctactagcccgtcccccagggtcaccatctttaattcttttccttcttttctttggagaggcacaaggagaatttaagggtccatggattcagtcttgctccttgtaattaaactgcaggatggaggaacagcctgagatatgagcatgagcccattttggggtaagcctttggttactttaattactccatggaagacatggaaaatgtccccactgattcttaaacatttggaatcccagtctgcaactattaatctggaggctatatctattttgttttgctttttggttggggggtggtgatctggttcttacacatcttggaagcaagaacaatcaggaccaaagtcactttgatcccacttttccaggagaaaaaccacctgtttggccagtgagaactacttgtatgaaataatttggccaaaccttcagtgtgaccaaatgtgagactgggagtttgtgtttttcacaggaaccctaagtatagacctctgctgctcatcaggaaacttactggagatgaaggccccagctgttgtcaccgggtttggaaagcaccttaactgaatcatgtaagcatcaggacataagcagcactttgtggtcaaatgtggaagccggagacttcaaagcacctctgggacccactggttgaagtttgcaatagaaacttaagttttcccaaatccataaagccttagccctggttctcaatagaatcagggacctagcaggaaatgattttactcaacctaaaatgctggatcccaggcccgtgtagctataagaattctggcctggatcccaggtgtacaactatggacaagatatgggcctctactttctcctctataaaatgaggctggatgaaatgtcagctagggccattttggctgctgaggctctgggatttggtttagttactgaatgttagattttctgcctagaaagataactatctagatacaagtggttggatcctgtttttgtttgtggtacatgtgtctttccaagagagatgtgtcaccaattagccctgcctttaaagaaactattatgtgtattcctgggactcactgacaccaattttctttttatagtgatggttcaattttgaaaagatggcttttgtgaggccaggttaaggtgaccaggatcttgtatgatgaattccttccatccctgagactctggtactatattgtaaacctggctacagtagttaattacttgagattctttaattttggtctctgagctgggcgtggtggttcatgcctgtaatcccagcactttgggaggccaaggtgtgcggatcacaaggtcaggagttcgagacccgcctggccaagatggtgaaaccccatctctactaaaaatacaaaaattagctgggcggtggtggcgggctcctgtagtcccagctactcgggaggctgaggcagaagaatcacgtgaacccaggaggcagaagtggcagtgagccaagatcgcaccactgcactccagcctgggcgacagagcaagactctgcctcaaaaaaaaaaaaaaaaaaaaaaaatttttttttttttggtctctggaaatgaacacaagggcaggttattcctgggtcacttctgggcccccctgccctcccagccccacttgagtttctctctctggtgtgggtgaaccagtcagcctgaatgttctgcatttcagcactttagaacctccctgtgaagattttagccttagcccaaacatcaaattagatggttcacatgatggtttttgacctatttcctttctaatgtattccacatgatcatggtgttaaatagtgaaaagtactgtgttgtgtgtgcaccttctccgtgcatttattagactaaccagtcaagcagacagctcagttagggagaaaacaatactctgaaatttgaaggccaatctgttgttactaagctgtttatctctattgcctttttaaatgtctggataagtt

SEQ ID NO: 301879 - DNA, 3024 bp, Homo sapiens
ggcacgagggcagggagtgcgggtcggttctgcgtgcgctgccggacgaggctcccgccgccgattgacccgcgctccgcccgtagtcgggccgggaccttggtagctaatgtccgaagaaagtgactctctgagaaccagcccttctgtggcctcactctctgaaaatgagctgccaccaccacctgagcctccgggctatgtgtgctcactgacagaagacctggtcaccaaagcccgggaagagctgcaggaaaagccggaatggagacttcgagatgtgcaggcccttcgtgacatggtgcggaaggagtaccccaacctgagcacatccctcgacgatgccttcctgctgcgcttcctccgagcccgcaagtttgattacgaccgggccctgcagctcctcgtcaactaccacagctgtagaagaagctggcccgaagtcttcaataacttgaagccatcagccttaaaagatgtccttgcttccgggttcctcaccgtgctgccccacactgaccccaggggctgccatgtcgtctgcatccgcccagacagatggataccaagcaactatccaattactgaaaacatccgagccatatacttgaccttagaaaaactcattcagtctgaagaaacccaggatggtttccccattcggataaaagcagtccatgtggtgaatgaacctcgaatatttaaaggcatttttgccatcataaaaccatttctaaaggagaaaatagcaaacagattcttcctccatgggtctgacttgaactctctccacacaaaccttccaagaagcatcctccccaaggagtatgggggcacggctggggagctggacactgccacctggaacgcggtactgctggcttcagaagacgattttgtgaaagagttctgccaacctgttcctgcctgtgacagcatcctgggccagacgctgctgcccgagggcctgacctcagatgcacagtgtgacgactccttgcgagctgtgaagtcacagctgtactcctgctactagcccgtcccccagggtcaccatctttaattcttttccttcttttctttggagaggcacaaggagaatttaagggtccatggattcagtcttgctccttgtaattaaactgcaggatggaggaacagcctgagatatgagcatgagcccattttggggtaagcctttggttactttaattactccatggaagacatggaaaatgtccccactgattcttaaacatttggaatcccagtctgcaactattaatctggaggctatatctattttgttttgctttttggttggggggtggtgatctggttcttacacatcttggaagcaagaacaatcaggaccaaagtcactttgatcccacttttccaggagaaaaaccacctgtttggccagtgagaactacttgtatgaaataatttggccaaaccttcagtgtgaccaaatgtgagactgggagtttgtgtttttcacaggaaccctaagtatagacctctgctgctcatcaggaaacttactggagatgaaggccccagctgttgtcaccgggtttggaaagcaccttaactgaatcatgtaagcatcaggacataagcagcactttgtggtcaaatgtggaagccggagacttcaaagcacctctgggacccactggttgaagtttgcaatagaaacttaagttttcccaaatccataaagccttagccctggttctcaatagaatcagggacctagcaggaaatgattttactcaacctaaaatgctggatcccaggcccgtgtagctataagaattctggcctggatcccaggtgtacaactatggacaagatatgggcctctactttctcctctataaaatgaggctggatgaaatgtcagctagggccattttggctgctgaggctctgggatttggtttagttactgaatgttagattttctgcctagaaagataactatctagatacaagtggttggatcctgtttttgtttgtggtacatgtgtctttccaagagagatgtgtcaccaattagccctgcctttaaagaaactattatgtgtattcctgggactcactgacaccaattttctttttatagtgatggttcaattttgaaaagatggcttttgtgaggccaggttaaggtgaccaggatcttgtatgatgaattccttccatccctgagactctggtactatattgtaaacctggctacagtagttaattacttgagattctttaattttggtctctgagctgggcgtggtggttcatgcctgtaatcccagcactttgggaggccaaggtgtgcggatcacaaggtcaggagttcgagacccgcctggccaagatggtgaaaccccatctctactaaaaatacaaaaattagctgggcggtggtggcgggctcctgtagtcccagctactcgggaggctgaggcagaagaatcacgtgaacccaggaggcagaagtggcagtgagccaagatcgcaccactgcactccagcctgggcgacagagcaagactctgcctcaaaaaaaaaaaaaaaaaaaaaaaatttttttttttttggtctctggaaatgaacacaagggcaggttattcctgggtcacttctgggcccccctgccctcccagccccacttgagtttctctctctggtgtgggtgaaccagtcagcctgaatgttctgcatttcagcactttagaacctccctgtgaagattttagccttagcccaaacatcaaattagatggttcacatgatggtttttgacctatttcctttctaatgtattccacatgatcatggtgttaaatagtgaaaagtactgtgttgtgtgtgcaccttctccgtgcatttattagactaaccagtcaagcagacagctcagttagggagaaaacaatactctgaaatttgaaggccaatctgttgttactaagctgtttatctctattgcctttttaaatgtctggataagtt

SEQ ID NO: 301880 - DNA, 1409 bp, Homo sapiens
ctgtgcgcggagggcgtggcctgtgcggggcgggacttattgcccgcgcggtgagggagcgtggtctcgcgcaagccggcgtgcggtccggcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagagggaagtgcggctccttcgaagacaaacaaaaacatctttggaagtttctttgctagaaaaatatccgtgctccaagtttataattgctataggaaataatgcagtagcatttctgtcatcatttgttatgaattcaggagtctgggaggaagttggttgtgctaaactctggaatgaatggtgtagaacaacagacactacacatctgtcctccacagaggctttttgtgtgttttatcatctaaaatccaatccctcggtttttctctgtcagtgcagttgctatgttgcagaagatcaacagtatcagtggctggaaaaggtttttggctcttgtccaaggaagaacatgcagataactattctcacatgtcgacatgttaccgattataaaacctcagaatccaccggcagccttccttctcctttcctgagagccctaaaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatgatcttaaacattgttttgtagtgtatattacttgtccattcctttaaggggagcagcctgcactcttttgtagattacttttgggggatatattttgagaatgatgaaacggaataaaattgtaaaaaactaaaaaaaaaaaaaaaaaaaaaaaaattttaaaaaaaaaaaaaacagaacaaaaacaaaaaaatgtgtgtcgggggcccgtcgccccccagaaaagagttttcaacaacaccattgcttggggggccggcggacgccaaggtgtaatgcacacacgcgcacacagctgttcccaagggaaaccggggagagcaacaggggggcgtcccccaaaaaaaaggcgggggcaccgcgttctcgacacaccagggggcgcggcaacgggccacacagaggccgagacct

SEQ ID NO: 301881 - DNA, 1383 bp, Homo sapiens
ctgtgcgcggagggcgtggcctgtgcggggcgggacttattgcccgcgcggtgagggagcgtggtctcgcgcaagccggcgtgcggtccggcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggagggaagtgcggctccttcgaagacaaacaaaaacatctttggaagtttctttgctagaaaaatatccgtgctccaagtttataattgctataggaaataatgcagtagcatttctgtcatcatttgttatgaattcaggagtctgggaggaagttggttgtgctaaactctggaatgaatggtgtagaacaacagacactacacatctgtcctccacagaggctttttgtgtgttttatcatctaaaatccaatccctcggtttttctctgtcagtgcagttgctatgttgcagaagatcaacagtatcagtggctggaaaaggtttttggctcttgtccaaggaagaacatgcagataactattctcacatgtcgacatgttaccgattataaaacctcagaatccaccggcagccttccttctcctttcctgagagccctaaaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatgatcttaaacattgttttgtagtgtatattacttgtccattcctttaaggggagcagcctgcactcttttgtagattacttttgggggatatattttgagaatgatgaaacggaataaaattgtaaaaaactaaaaaaaaaaaaaaaaaaaaaaaaattttaaaaaaaaaaaaaacagaacaaaaacaaaaaaatgtgtgtcgggggcccgtcgccccccagaaaagagttttcaacaacaccattgcttggggggccggcggacgccaaggtgtaatgcacacacgcgcacacagctgttcccaagggaaaccggggagagcaacaggggggcgtcccccaaaaaaaaggcgggggcaccgcgttctcgacacaccagggggcgcggcaacgggccacacagaggccgagacct

SEQ ID NO: 301882 - DNA, 1358 bp, Homo sapiens
ctgtgcgcggagggcgtggcctgtgcggggcgggacttattgcccgcgcggtgagggagcgtggtctcgcgcaagccggcgtgcggtccggcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagagggaagtgcggctccttcgaagacaaacaaaaacatctttggaagtttctttgctagaaaaatatccgtgctccaagtttataattgctataggaaataatgcagtagcatttctgtcatcatttgttatgaattcaggagtctgggaggaagttggttgtgctaaactctggaatgaatggtgtagaacaacagacactacacatctgtcctccacagaggctttttgtgtgttttatcatctaaaatccaatccctcggtttttctctgtcagtgcagttgctatgttgcagaagatcaacagtatcagtggctggaaaaggtttttggctcttgtccaaggaagaacatgcagataactattctcacatgtcgacatgttaccgattataaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatgatcttaaacattgttttgtagtgtatattacttgtccattcctttaaggggagcagcctgcactcttttgtagattacttttgggggatatattttgagaatgatgaaacggaataaaattgtaaaaaactaaaaaaaaaaaaaaaaaaaaaaaaattttaaaaaaaaaaaaaacagaacaaaaacaaaaaaatgtgtgtcgggggcccgtcgccccccagaaaagagttttcaacaacaccattgcttggggggccggcggacgccaaggtgtaatgcacacacgcgcacacagctgttcccaagggaaaccggggagagcaacaggggggcgtcccccaaaaaaaaggcgggggcaccgcgttctcgacacaccagggggcgcggcaacgggccacacagaggccgagacct

SEQ ID NO: 301883 - DNA, 1225 bp, Homo sapiens
ctgtgcgcggagggcgtggcctgtgcggggcgggacttattgcccgcgcggtgagggagcgtggtctcgcgcaagccggcgtgcggtccggcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagagggaagtgcggctccttcgaagacaaacaaaaacatctttggaagtttctttgctagaaaaatatccgtgctccaagtttataattgctataggaaataatgcagtagcatttctgtcatcatttgttatgaattcaggagtctgggaggaagttggttgtgctaaactctggaatgaatggtgtagaacaacagacactacacatctgtcctccacagaggctttttgtgtgttttatcatctaaaatccaatccctcgaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatgatcttaaacattgttttgtagtgtatattacttgtccattcctttaaggggagcagcctgcactcttttgtagattacttttgggggatatattttgagaatgatgaaacggaataaaattgtaaaaaactaaaaaaaaaaaaaaaaaaaaaaaaattttaaaaaaaaaaaaaacagaacaaaaacaaaaaaatgtgtgtcgggggcccgtcgccccccagaaaagagttttcaacaacaccattgcttggggggccggcggacgccaaggtgtaatgcacacacgcgcacacagctgttcccaagggaaaccggggagagcaacaggggggcgtcccccaaaaaaaaggcgggggcaccgcgttctcgacacaccagggggcgcggcaacgggccacacagaggccgagacct

SEQ ID NO: 301884 - DNA, 746 bp, Homo sapiens
cgggttagagcatagacttcctccagaggccaggagaccatcggaggccaggagatcatcggcgagtgtggcagggaaagggcctgttgaactgactttcccacttgccttttcgttgagaaggagagtaaaggccacgcctgtcccatggctgtttttaagtctcgagtgtggagattgttggtcgtggagggaggggtgttgcctctgcctgaatccctggggtctcactgtattcacttttttctctcctttcagaatattccccaaagcactgagatactaaagaaattgatgacaacaaatgagattcagagtaacatttatacatgatcttaaacattgttttgtagtgtatattacttgtccattcctttaaggggagcagcctgcactcttttgtagattacttttgggggatatattttgagaatgatgaaacggaataaaattgtaaaaaactaaaaaaaaaaaaaaaaaaaaaaaaattttaaaaaaaaaaaaaacagaacaaaaacaaaaaaatgtgtgtcgggggcccgtcgccccccagaaaagagttttcaacaacaccattgcttggggggccggcggacgccaaggtgtaatgcacacacgcgcacacagctgttcccaagggaaaccggggagagcaacaggggggcgtcccccaaaaaaaaggcgggggcaccgcgttctcgacacaccagggggcgcggcaacgggccacacagaggccgagacct

SEQ ID NO: 301885 - DNA, 852 bp, Homo sapiens
ctgtgcgcggagggcgtggcctgtgcggggcgggacttattgcccgcgcggtgagggagcgtggtctcgcgcaagccggcgtgcggtccggcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagagggaagtgcggctccttcgaagacaaacaaaaacatctttggaagtttctttgctagaaaaatatccgtgctccaagtttataattgctataggaaataatgcagtagcatttctgtcatcatttgttatgaattcaggagtctgggaggaagttggttgtgctaaactctggaatgaatggtgtagaacaacagacactacacatctgtcctccacagaggctttttgtgtgttttatcatctaaaatccaatccctcgaaaccctaaaccctcctacctttggccagtgggagctcctgtaataggctcttgtgttcttttgatataaccattagaccttattagctttcctgctttctagcacaataaaatgctctagttttttttcttttttttctttttttgagacggagtatcactctgtcacccaggctggagtgcagtggtgcaatctcagctcactgaaacctccgcctcccaagttcaagtgattctcctgcctcagtctcctgagtagctgggattataggcactggccaccatgcccggctaatttttgtatttttagtagagacagggtttcgatga

SEQ ID NO: 301886 - DNA, 827 bp, Homo sapiens
tttttttttttgtatttttagtagagacagggtttccccatgttagccaggatggtcttgatctcctgacctcatgatcctcctgcctcagcctcccaaagtgctgggattataggcgtgagcaccccacctggccactatccttcgatattttttttaagacatggtttccttgaggtgtttgaatatgcctataattgccgatttaaaaagtttatttagtgaatctaagtctgggctccctcagagacagtttctgttgactgctttttttcctgtttgagtgtttcataatattttgttgaaaattgggcatttaaaataaaataatgtggcaactctggaaattggatattccctttctcctcccccaggatttgctgctgttgctgtttattgttacagcttgcctagtgacttttcctggacaaaggctatataaagtccgtccccttaagtccctgcttgtttagtttagtggttagctaatggttggacagagaagtcaccacaaccactgtctcctatcctttaccgacggcttgtgtgtttgtgttggggtgtgccatcacttcctatttgtgtagacagtcatgctcagccacaggtgacaaatgaggaccccctcacgtctttcctgggtgtgcacatggccttgcacctgcatgtggctgtctagatccccaggaatgtattggaccttttcaaagcccaccattaacactgtattccccacattttcctttatagttttttggccagctgcttgtttgccccatgggtattgtcccctcagacagctgcgctgttgaacagtggctactgat

SEQ ID NO: 301887 - DNA, 815 bp, Homo sapiens
attgtttctctctgctgccggagctccaggtctacccttcactgctctgtgtcctcagcgtgtgtggcttcgtgacctgaagatactgggaaatccatagctaagatgccaggaccccctgaaagcctagacatggtgagagtgctgggtccgacatcacgagagaggggaaggagttgctcggaaccggtgggaagtggctgtggcgggactcaggcctccccgcagtcagctccacaatctgctccctgagttctccttgcccagctcggcctcagtctccttcagccgtaagttggcggctgcgccaacagccggggccccgggcgtcctgtctcttccctgcactgtgactgtgccctgcctggagtcctctctggcagttctgcacccgcagcgccgcgtctttctcagattgtgcggggaccacgggagggtcatcaggggagaatcctgacttggggtgcgggttcatgaatgggaagagctttggtccgtggggttcccagttgctattttctcctattaaaaatttatgggcgtcactgcaaaaatattaaagaatgtaatcaaagagtggttctagaattgtagagcacccagctatggtttgtagttgtggtctgtgggagaggcttgaaggaaagtcttttataaaatgcatgatgaagaaaccaaatttactaattgggttaggtacagttacatggtttcttaatatgtgcgttaaaggtgaaaatttcctggttatgtaatcagagcttaattggcagtttacagttgctgaagcctgaattttgtttctctgaatgtag

SEQ ID NO: 301888 - DNA, 950 bp, Homo sapiens
ataatctgcactacttaaaatgttccctttgttgccattgaacgtgggaaaatgtagatattcaagattcccattggcggaaagctggggtccttagtaaagataaataacatgtaatgttgtggtttcatctgttttctccattaattctatgcagaacaggattaataaaatgcttatttaaacaggatggtgtttattaccctgaaagttctgaaaaaaagttattgagagatacctgctctctcaggtgctaaagaaagactactttaaaatgttattaaaaattgcagaacatagaagatatctgcattttgaactctgcataaaactgatttttctgtatggttaacctcagactataatttactttttgaggggcaatatctcagcagtgatgatgtcttcttctgtgtgcatcagcacatcataaacatttgtcctaatgcagttgattttaaaatttacttaaaagagctctctgaaatatttatttcactatagagttaattatttttctcttcattattaagtatctttatgtagctaaggaagagctgtgcataaaccatcacatttaatctggcagctgcctttctttgttaggttttccttgcatttatctgtctttggaaaatgaagactcttatctttgtttacagagcccgaccccaccgcctcgaccaccatgccattactcgcgcgctcctcgttacaatccctacaatctacacctttctcaccccctgttgtttatcctgtccctcacacaccccatttcttttacttcctcaccctcaatcttagacacaccactctttctatattccaattcatcgttccacaactctgtcaacttcacaaattccaaacctcctcacacctcccccacactctaatctctcctttttatatgttcctccctattttagaatctcctcccccgctct

SEQ ID NO: 301889 - DNA, 1680 bp, Homo sapiens
  misc_feature (723)..(723): n is a, c, g, or t
  misc_feature (1116)..(1116): n is a, c, g, or t
  misc_feature (1127)..(1127): n is a, c, g, or t
attgtttctctctgctgccggagctccaggtctacccttcactgctctgtgtcctcagcgtgtgtggcttcgtgacctgaagatactgggaaatccatagctaagatgccaggaccccctgaaagcctagacatggggccgttgacatttagggatgtggccatagaattctctctggaggagtggcaatgcctggacactgctcagcaggatttgtataggaaagtgatgttagagaactacagaaacctggtcttcttggcaggtattgctgtctctaagccagatctggtcacctgtctggagcaaggaaaagatccctggaatatgaagggacacagtacggtagtcaaacccccagtagagacggggtttcaccgttttggccaggatggtctctatctcctgacctcgtgatccgcccgcctcagtctcccaaagtgctggtattacaggcgtgagccaccatgcccagcctaataaaaatttttttatttctattgtatccaatagcttgttttaagtgtgtagaacaataacttacacttttatgttaattttatattttgttaatttactgactgtattattagtttagacaaatttcaatgtactgtggttttttatgtgtaagattatatattcctcaaacagcaactttttacttatttgtcttcagtttcaatggctttaaaaagaattcttttttcattattctgccanatgcttccagtgctatgttaaaatagaaacattgacaaagggcacaatagagtttactattggtgtctgtgaatttgaaatggcaaacaactccttaagtttttataagctgatttcaggaggtaaagatcttcttttcttgtgttccccagggttttgggatgccctctgggtttgtagtggagtggggttgtaacttggttgcaaggctgctggttctacattagggtccatatttagttgtcatgttacaagaggcttgggtagttgtacttcccaatttttttttttttttttttttttgagacaggagtctcgctctgtcgcctggctggagtgcagtggtgtgatctcagctcatcaaaacctttgcctccctagttcaagcgattntcctacctcancctcctgagtagctgggattacaggtgcccaccagcacgcccagctaattttttgtgtgtttttagtggagacggggtttcaccatgttggctaagctgggtctcgaactcctgacctcaggtgatccacccgccttggcctcctgggtgctgggattacagacgtgagccaccacccccggccacttgtttcttttaaatgcttattaaaagtttctcatcagaatattttatttataattatactgcatattctctgaaattttactgccaatttttcaaaatacctgcttttgatgagtacagttacagtcaaatactgtagttagacaaattcttttttaatggtatattaatgttgcataccaaattgtatgagttaaacgtctcttcctgtgcagtttcatattagtggtgttttcagtgtaggtatcttaatatcagcttatcgtggtttttggttatgtattataattttagtcaatttgcaattctgtctgtatactttatgtcaatgtgaggttgaattaaaagatagccatatgtctatcac

SEQ ID NO: 301890 - DNA, 2000 bp, Homo sapiens
ataatctgcactacttaaaatgttccctttgttgccattgaacgtgggaaaatgtagatattcaagattcccattggcggaaagctggggtccttagtaaagataaataacatgtaatgttgtggtttcatctgttttctccattaattctatgcagaacaggattaataaaatgcttatttaaacaggatggtgtttattaccctgaaagttctgaaaaaaagttattgagagatacctgctctctcaggtgctaaagaaagactactttaaaatgttattaaaaattgcagaacatagaagatatctgcattttgaactctgcataaaactgatttttctgtatggttaacctcagactataatttactttttgaggggcaatatctcagcagtgatgatgtcttcttctgtgtgcatcagcacatcataaacatttgtcctaatgcagttgattttaaaatttacttaaaagagctctctgaaatatttatttcactatagagttaattatttttctcttcattattaagtatctttatgtagctaaggaagagctgtgcataaaccatcacatttaatctggcagctgcctttctttgttaggttttccttgcatttatctgtctttggaaaatgaagactcttatctttgtttacagggcagaaaaattgagtaaaacacaggatcttccacttactggatattgacaaaatattctttctgggccaaacacattggcattactagtgaacttgttagaaattcagaaactcagagtttatttcagatcttctgggaaaaaagaatctgcacaagatctccagtttactgttcacattaaaacttgagaggtgccttctaactcaacatatcttttgtctgaaaaatatacacaactcattctttgtgtggcaaatatagcactaaaaaatgtacatgtttgtgtttatgcctttagctttatactttactattaataaaagtatatatacagtggtgttgtagatcttataccattctcttctctcagagttagagaatacattagagaatatttctgtgttgaaaattgttggataatttcagtcattcctgtaagtcagaacgaattttctttactttctcatttgaccttaattcaaatgataaattttgcccacgtgtaaatgtgtgtgtgtgtgtgtgtgtttgtgtgtgtttgtttcaggggccgttgacatttagggatgtggccatagaattctctctggaggagtggcaatgcctggacactgctcagcaggatttgtataggaaagtgatgttagagaactacagaaacctggtcttcttgggtgagaataactttaatacaaaatcccttatataccctaaagttttcatttctctgttttcatagaataatttttggtaatttatgctttgcataagtgagtttctgatgcctgttttaaagaaatcttgaagaactgtccgtgtggaaaaaaatttcttcaggatgttttatcttggcctgatctttttacatttctgagccggtctgtatccttcactctacagtagtggtaatttcagaaatttagtagtataaaatattgttgtccatatgttaaaatctatatgccaccactaattttttatccatgaatactgggtggcaaaattaagcacctacaaatttaaaatattttctaaatgttaagaactttctgtcattaaatagtattttgggataaattttctagaatattctattacatcctctttactaagcatggtactaggtaggtaattagagaatatgagcaagattcatgttatttatttttaataaagcaggtattgctgtctctaagccagatctggtcacctgtctggagcaaggaaaagatccctggaatatgaagggacacagtacggtagtcaaacccccaggtaggtgagagtgaatgaaacagttgacatagatgaaaggttgaaagatttaaaaaaaaaa

SEQ ID NO: 301891 - DNA, 3564 bp, Homo sapiens
  misc_feature (2301)..(2301): n is a, c, g, or t
  misc_feature (2694)..(2694): n is a, c, g, or t
  misc_feature (2705)..(2705): n is a, c, g, or t
ataatctgcactacttaaaatgttccctttgttgccattgaacgtgggaaaatgtagatattcaagattcccattggcggaaagctggggtccttagtaaagataaataacatgtaatgttgtggtttcatctgttttctccattaattctatgcagaacaggattaataaaatgcttatttaaacaggatggtgtttattaccctgaaagttctgaaaaaaagttattgagagatacctgctctctcaggtgctaaagaaagactactttaaaatgttattaaaaattgcagaacatagaagatatctgcattttgaactctgcataaaactgatttttctgtatggttaacctcagactataatttactttttgaggggcaatatctcagcagtgatgatgtcttcttctgtgtgcatcagcacatcataaacatttgtcctaatgcagttgattttaaaatttacttaaaagagctctctgaaatatttatttcactatagagttaattatttttctcttcattattaagtatctttatgtagctaaggaagagctgtgcataaaccatcacatttaatctggcagctgcctttctttgttaggttttccttgcatttatctgtctttggaaaatgaagactcttatctttgtttacagggcagaaaaattgagtaaaacacaggatcttccacttactggatattgacaaaatattctttctgggccaaacacattggcattactagtgaacttgttagaaattcagaaactcagagtttatttcagatcttctgggaaaaaagaatctgcacaagatctccagtttactgttcacattaaaacttgagaggtgccttctaactcaacatatcttttgtctgaaaaatatacacaactcattctttgtgtggcaaatatagcactaaaaaatgtacatgtttgtgtttatgcctttagctttatactttactattaataaaagtatatatacagtggtgttgtagatcttataccattctcttctctcagagttagagaatacattagagaatatttctgtgttgaaaattgttggataatttcagtcattcctgtaagtcagaacgaattttctttactttctcatttgaccttaattcaaatgataaattttgcccacgtgtaaatgtgtgtgtgtgtgtgtgtgtttgtgtgtgtttgtttcaggggccgttgacatttagggatgtggccatagaattctctctggaggagtggcaatgcctggacactgctcagcaggatttgtataggaaagtgatgttagagaactacagaaacctggtcttcttgggtgagaataactttaatacaaaatcccttatataccctaaagttttcatttctctgttttcatagaataatttttggtaatttatgctttgcataagtgagtttctgatgcctgttttaaagaaatcttgaagaactgtccgtgtggaaaaaaatttcttcaggatgttttatcttggcctgatctttttacatttctgagccggtctgtatccttcactctacagtagtggtaatttcagaaatttagtagtataaaatattgttgtccatatgttaaaatctatatgccaccactaattttttatccatgaatactgggtggcaaaattaagcacctacaaatttaaaatattttctaaatgttaagaactttctgtcattaaatagtattttgggataaattttctagaatattctattacatcctctttactaagcatggtactaggtaggtaattagagaatatgagcaagattcatgttatttatttttaataaagcaggtattgctgtctctaagccagatctggtcacctgtctggagcaaggaaaagatccctggaatatgaagggacacagtacggtagtcaaacccccagtagagacggggtttcaccgttttggccaggatggtctctatctcctgacctcgtgatccgcccgcctcagtctcccaaagtgctggtattacaggcgtgagccaccatgcccagcctaataaaaatttttttatttctattgtatccaatagcttgttttaagtgtgtagaacaataacttacacttttatgttaattttatattttgttaatttactgactgtattattagtttagacaaatttcaatgtactgtggttttttatgtgtaagattatatattcctcaaacagcaactttttacttatttgtcttcagtttcaatggctttaaaaagaattcttttttcattattctgccanatgcttccagtgctatgttaaaatagaaacattgacaaagggcacaatagagtttactattggtgtctgtgaatttgaaatggcaaacaactccttaagtttttataagctgatttcaggaggtaaagatcttcttttcttgtgttccccagggttttgggatgccctctgggtttgtagtggagtggggttgtaacttggttgcaaggctgctggttctacattagggtccatatttagttgtcatgttacaagaggcttgggtagttgtacttcccaatttttttttttttttttttttttgagacaggagtctcgctctgtcgcctggctggagtgcagtggtgtgatctcagctcatcaaaacctttgcctccctagttcaagcgattntcctacctcancctcctgagtagctgggattacaggtgcccaccagcacgcccagctaattttttgtgtgtttttagtggagacggggtttcaccatgttggctaagctgggtctcgaactcctgacctcaggtgatccacccgccttggcctcctgggtgctgggattacagacgtgagccaccacccccggccacttgtttcttttaaatgcttattaaaagtttctcatcagaatattttatttataattatactgcatattctctgaaattttactgccaatttttcaaaatacctgcttttgatgagtacagttacagtcaaatactgtagttagacaaattcttttttaatggtatattaatgttgcataccaaattgtatgagttaaacgtctcttcctgtgcagtttcatattagtggtgttttcagtgtaggtatcttaatatcagcttatcgtggtttttggttatgtattataattttagtcaatttgcaattctgtctgtatactttatgtcaatgtgaggttgaattaaaagatagccatatgtctatcacaatcatatatgtgtgtgtgtttatctataaatatgaccccaatattggttatggcttatcttgtatatattctttctttctttctttttttttttttttttttaaggtggagtctcgctctgtcgcccaggctggagtgtgcagtggaacaatctcggctcactgcaacctcctcctcccgggttcacgtcattctcctgcctcagcctcccaagtagctgggactacaggcgcctgcaaccacgcctggctaattttttgtatttttagcagagacggggtttcaccatattagccaggatggtc

SEQ ID NO: 301892 - DNA, 446 bp, Homo sapiens
attgtttctctctgctgccggagctccaggtctacccttcactgctctgtgtcctcagcgtgtgtggcttcgtgacctgaagatactgggaaatccatagctaagatgccaggaccccctgaaagcctagacatggggccgttgacatttagggatgtggccatagaattctctctggaggagtggcaatgcctggacactgctcagcaggatttgtataggaaagtgatgttagagaactacagaaacctggtcttcttggcaggtattgctgtctctaagccagatctggtcacctgtctggagcaaggaaaagatccctggaatatgaagggacacagtacggtagtcaaacccccagttatatgttctcattttgctgaagacttttgcccagggccaggcattaaagattcttttcaaaaagtgatactgagagaatatgt

SEQ ID NO: 301893 - DNA, 4756 bp, Homo sapiens
  misc_feature (245)..(245): n is a, c, g, or t
gcgacgctcacgaacgatcagagctgcgggcgacgcaacgaagcccggaggccgcaggctgcgcgctccctcgcagcagccgggcgggcaaaagcccccagtcctcggcccccgcgcaagcgacgccgggaaatgcccacatccgggaaacctgcagcggagtgcggcggcggcgacactgagtggaaggcaaaatggcggcggcggcggcggtggcctggtgttaaggggagagccaggtcctnacgacccctgggacgggccgcgctggcccgcggcagcccccccgttcgtctccccgctctgccccaccagggatacttggggttgctgggacggactctggccgcctcagcgtccgccctcaggcccgtggccgctgtccaggagctctgctctcccctccagagttaattatttatattgtaaagaattttaacagtcctggggacttccttgaaggatcattttcacttttgctcagaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggatatggttatacaagctcttcagaaaactaacaacagaagtatagaagcagcaattgaattcattagtaaaatgagttaccaagatcctcgacgagagcagatggctgcagcagctgccagacctattaatgccagcatgaaaccagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccctagcaacggacagagagtgaaccccccaccaccacctcaagtaaggagtgttactcctccaccacctccaagaggccagactccccctccaagaggtacaactccacctcccccttcatgggaaccaaactctcaaacaaagcgctattctggaaacatggaatacgtaatctcccgaatctctcctgtcccacctggggcatggcaagagggctatcctccaccacctctcaacacttcccccatgaatcctcctaatcaaggacagagaggcattagttctgttcctgttggcagacaaccaatcatcatgcagagttctagcaaatttaactttccatcagggagacctggaatgcagaatggtactggacaaactgatttcatgatacaccaaaatgttgtccctgctggcactgtgaatcggcagccaccacctccatatcctctgacagcagctaatggacaaagcccttctgctttacaaacagggggatctgctgctccttcgtcatatacaaatggaagtattcctcagtctatgatggtgccaaacagaaatagtcataacatggaactatataacattagtgtacctggactgcaaacaaattggcctcagtcatcttctgctccagcccagtcatccccgagcagtgggcatgaaatccctacatggcaacctaacataccagtgaggtcaaattcttttaataacccattaggaaatagagcaagtcactctgctaattctcagccttctgctacaacagtcactgcaattacaccagctcctattcaacagcctgtgaaaagtatgcgtgtattaaaaccagagctacagactgctttagcacctacacacccttcttggataccacagccaattcaaactgttcaacccagtccttttcctgagggaaccgcttcaaatgtgactgtgatgccacctgttgctgaagctccaaactatcaaggaccaccaccaccctacccaaaacatctgctgcaccaaaacccatctgttcctccatacgagtcaatcagtaagcctagcaaagaggatcagccaagcttgcccaaggaagatgagagtgaaaagagttatgaaaatgttgatagtggggataaagaaaagaaacagattacaacttcacctattactgttaggaaaaacaagaaagatgaagagcgaagggaatctcgtattcaaagttattctcctcaagcatttaaattctttatggagcaacatgtagaaaatgtactcaaatctcatcagcagcgtctacatcgtaaaaaacaattagagaatgaaatgatgcgggttggattatctcaagatgcccaggatcaaatgagaaagatgctttgccaaaaagaatctaattacatccgtcttaaaagggctaaaatggacaagtctatgtttgtgaagataaagacactaggaataggagcatttggtgaagtctgtctagcaagaaaagtagatactaaggctttgtatgcaacaaaaactcttcgaaagaaagatgttcttcttcgaaatcaagtcgctcatgttaaggctgagagagatatcctggctgaagctgacaatgaatgggtagttcgtctatattattcattccaagataaggacaatttatactttgtaatggactacattcctgggggtgatatgatgagcctattaattagaatgggcatctttccagaaagtctggcacgattctacatagcagaacttacctgtgcagttgaaagtgttcataaaatgggttttattcatagagatattaaacctgataatattttgattgatcgtgatggtcatattaaattgactgactttggcctctgcactggcttcagatggacacacgattctaagtactatcagagtggtgaccatccacggcaagatagcatggatttcagtaatgaatggggggatccctcaagctgtcgatgtggagacagactgaagccattagagcggagagctgcacgccagcaccagcgatgtctagcacattctttggttgggactcccaattatattgcacctgaagtgttgctacgaacaggatacacacagttgtgtgattggtggagtgttggtgttattctttttgaaatgttggtgggacaacctcctttcttggcacaaacaccattagaaacacaaatgaaggttatcaactggcaaacatctcttcacattccaccacaagctaaactcagtcctgaagcttctgatcttattattaaactttgccgaggacccgaagatcgcttaggcaagaatggtgctgatgaaataaaagctcatccattttttaaaacaattgacttctccagtgacctgagacagcagtctgcttcatacattcctaaaatcacacacccaacagatacatcaaattttgatcctgttgatcctgataaattatggagtgatgataacgaggaagaaaatgtaaatgacactctcaatggatggtataaaaatggaaagcatcctgaacatgcattctatgaatttaccttccgaaggttttttgatgacaatggctacccatataattatccgaagcctattgaatatgaatacattaattcacaaggctcagagcagcagtcggatgaagatgatcaaaacacaggctcagagattaaaaatcgcgatctagtatatgtttaacacactagtaaataaatgtaatgaggatttgtaaaagggcctgaaatgcgaggtgttttgaggttctgagagtaaaattatgcaaatatgacagagctatatatgtgtgctctgtgtacaatattttattttcctaaattatgggaaatccttttaaaatgttaatttattccagccgtttaaatcagtatttagaaaaaaattgttataaggaaagtaaattatgaactgaatattatagtcagttcttggtacttaaagtacttaaaataagtagtgctttgtttaaaaggagaaacctggtatctatttgtatatatgctaaataattttaaaatacaagagtttttgaaatttttttgaaagacagttttagttttatcttgctttaaccaaatatgaaacataccccctattttacagagctcttttttcccctcataaccttgtttttggtagaaaataagctagagaaattaagccatcgtgttggtgagtgttcctaggctaatgataatctgtataattcacatcctgaaactaaggaatacagggttgaaaaaatattaatatgtttgtcagaaggaaaaataatgcatttattttcccccccaccccccgccccatggaatatttaatctatttaatcttcttgcatttatttctcaagaattactggctttaaaagaagccaaagcactactagctttttttccatattggtatttttgatgctgcttccaattttaaaagggaacaaagctgccataaatcgaaatgttcaatactaaaagctaaaatatttctcaccatcg

SEQ ID NO: 301894 - DNA, 1354 bp, Homo sapiens
  misc_feature (245)..(245): n is a, c, g, or t
gcgacgctcacgaacgatcagagctgcgggcgacgcaacgaagcccggaggccgcaggctgcgcgctccctcgcagcagccgggcgggcaaaagcccccagtcctcggcccccgcgcaagcgacgccgggaaatgcccacatccgggaaacctgcagcggagtgcggcggcggcgacactgagtggaaggcaaaatggcggcggcggcggcggtggcctggtgttaaggggagagccaggtcctnacgacccctgggacgggccgcgctggcccgcggcagcccccccgttcgtctccccgctctgccccaccagggatacttggggttgctgggacggactctggccgcctcagcgtccgccctcaggcccgtggccgctgtccaggagctctgctctcccctccagagttaattatttatattgtaaagaattttaacagtcctggggacttccttgaaggatcattttcacttttgctcagaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggaggatcatctgtcagtagcctgttcacccattagtcttactaagccatttctcatttaaaaatgtcgtttgaaatactgaatcctctaggacaagatatggttatacaagctcttcagaaaactaacaacagaagtatagaagcagcaattgaattcattagtaaaatgagttaccaagatcctcgacgagagcagatggctgcagcagctgccagacctattaatgccagcatgaaaccagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccccaaagtattaaaagtagctttgtaattc

SEQ ID NO: 301895 - DNA, 3065 bp, Homo sapiens
  misc_feature (245)..(245): n is a, c, g, or t
gcgacgctcacgaacgatcagagctgcgggcgacgcaacgaagcccggaggccgcaggctgcgcgctccctcgcagcagccgggcgggcaaaagcccccagtcctcggcccccgcgcaagcgacgccgggaaatgcccacatccgggaaacctgcagcggagtgcggcggcggcgacactgagtggaaggcaaaatggcggcggcggcggcggtggcctggtgttaaggggagagccaggtcctnacgacccctgggacgggccgcgctggcccgcggcagcccccccgttcgtctccccgctctgccccaccagggatacttggggttgctgggacggactctggccgcctcagcgtccgccctcaggcccgtggccgctgtccaggagctctgctctcccctccagagttaattatttatattgtaaagaattttaacagtcctggggacttccttgaaggatcattttcacttttgctcagaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggatatggttatacaagctcttcagaaaactaacaacagaagtatagaagcagcaattgaattcattagtaaaatgagttaccaagatcctcgacgagagcagatggctgcagcagctgccagacctattaatgccagcatgaaaccagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccctagcaacggacagagagtgaaccccccaccaccacctcaagtaaggagtgttactcctccaccacctccaagaggccagactccccctccaagaggtacaactccacctcccccttcatgggaaccaaactctcaaacaaagcgctattctggaaacatggaatacgtaatctcccgaatctctcctgtcccacctggggcatggcaagagggctatcctccaccacctctcaacacttcccccatgaatcctcctaatcaaggacagagaggcattagttctgttcctgttggcagacaaccaatcatcatgcagagttctagcaaatttaactttccatcagggagacctggaatgcagaatggtactggacaaactgatttcatgatacaccaaaatgttgtccctgctggcactgtgaatcggcagccaccacctccatatcctctgacagcagctaatggacaaagcccttctgctttacaaacagggggatctgctgctccttcgtcatatacaaatggaagtattcctcagtctatgatggtgccaaacagaaatagtcataacatggaactatataacattagtgtacctggactgcaaacaaattggcctcagtcatcttctgctccagcccagtcatccccgagcagtgggcatgaaatccctacatggcaacctaacataccagtgaggtcaaattcttttaataacccattaggaaatagagcaagtcactctgctaattctcagccttctgctacaacagtcactgcaattacaccagctcctattcaacagcctgtgaaaagtatgcgtgtattaaaaccagagctacagactgctttagcacctacacacccttcttggataccacagccaattcaaactgttcaacccagtccttttcctgagggaaccgcttcaaatgtgactgtgatgccacctgttgctgaagctccaaactatcaaggaccaccaccaccctacccaaaacatctgctgcaccaaaacccatctgttcctccatacgagtcaatcagtaagcctagcaaagaggatcagccaagcttgcccaaggaagatgagagtgaaaagagttatgaaaatgttgatagtggggataaagaaaagaaacagattacaacttcacctattactgttaggaaaaacaagaaagatgaagagcgaagggaatctcgtattcaaagttattctcctcaagcatttaaattctttatggagcaacatgtagaaaatgtactcaaatctcatcagcagcgtctacatcgtaaaaaacaattagagaatgaaatgatgcgggtaaaaccttttaaaatgtccatttttatacttaatcatctgtttgcttggtgtttattttaaaatattgtgtccagtatttttctttctttttatagctaaataaaatatattatcagttatggaatttaaaagtgaataaatattaaagtacttttgattgtagcattttattttagtatttcaatatttattcagaatttcctataataaaatctcgtgtaaattaagaaaaatataatttgcggtatacagtttaggtgtacataatacctttatatgaaaattggaggaagggttgtcttctaggcttcatacaatatcttacaacatttaaaaataaactagaaatatgtgggtctcaggctggggcatgggggctcacgcctgtaatcaaagcactttggaaggctgaggcaggcagatcatgaggtcaggagatcgagaccatcctgcctaacacagtgaaaccccgtctctactaaaaataccaaaaaaaattagctg

SEQ ID NO: 301896 - DNA, 2624 bp, Homo sapiens
  misc_feature (245)..(245): n is a, c, g, or t
gcgacgctcacgaacgatcagagctgcgggcgacgcaacgaagcccggaggccgcaggctgcgcgctccctcgcagcagccgggcgggcaaaagcccccagtcctcggcccccgcgcaagcgacgccgggaaatgcccacatccgggaaacctgcagcggagtgcggcggcggcgacactgagtggaaggcaaaatggcggcggcggcggcggtggcctggtgttaaggggagagccaggtcctnacgacccctgggacgggccgcgctggcccgcggcagcccccccgttcgtctccccgctctgccccaccagggatacttggggttgctgggacggactctggccgcctcagcgtccgccctcaggcccgtggccgctgtccaggagctctgctctcccctccagagttaattatttatattgtaaagaattttaacagtcctggggacttccttgaaggatcattttcacttttgctcagaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggatatggttatacaagctcttcagaaaactaacaacagaagtatagaagcagcaattgaattcattagtaaaatgagttaccaagatcctcgacgagagcagatggctgcagcagctgccagacctattaatgccagcatgaaaccagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccctagcaacggacagagagtgaaccccccaccaccacctcaagtaaggagtgttactcctccaccacctccaagaggccagactccccctccaagaggtacaactccacctcccccttcatgggaaccaaactctcaaacaaagcgctattctggaaacatggaatacgtaatctcccgaatctctcctgtcccacctggggcatggcaagagggctatcctccaccacctctcaacacttcccccatgaatcctcctaatcaaggacagagaggcattagttctgttcctgttggcagacaaccaatcatcatgcagagttctagcaaatttaactttccatcagggagacctggaatgcagaatggtactggacaaactgatttcatgatacaccaaaatgttgtccctgctggcactgtgaatcggcagccaccacctccatatcctctgacagcagctaatggacaaagcccttctgctttacaaacagggggatctgctgctccttcgtcatatacaaatggaagtattcctcagtctatgatggtgccaaacagaaatagtcataacatggaactatataacattagtgtacctggactgcaaacaaattggcctcagtcatcttctgctccagcccagtcatccccgagcagtgggcatgaaatccctacatggcaacctaacataccagtgaggtcaaattcttttaataacccattaggaaatagagcaagtcactctgctaattctcagccttctgctacaacagtcactgcaattacaccagctcctattcaacagcctgtgaaaagtatgcgtgtattaaaaccagagctacagactgctttagcacctacacacccttcttggataccacagccaattcaaactgttcaacccagtccttttcctgagggaaccgcttcaaatgtgactgtgatgccacctgttgctgaagctccaaactatcaaggaccaccaccaccctacccaaaacatctgctgcaccaaaacccatctgttcctccatacgagtcaatcagtaagcctagcaaagaggatcagccaagcttgcccaaggaagatgagagtgaaaagagttatgaaaatgttgatagtggggataaagaaaagaaacagattacaacttcacctattactgttaggaaaaacaagaaagatgaagagcgaagggaatctcgtattcaaagttattctcctcaagcatttaaattctttatggagcaacatgtagaaaatgtactcaaatctcatcagcagcgtctacatcgtaaaaaacaattagagaatgaaatgatgcgggttggattatctcagatgcccggatccatgtgtagatgcttgccttttgatctataactccgtctt

SEQ ID NO: 301897 - DNA, 2484 bp, Homo sapiens
cggagtgcattagagaagagtagaaagcttactcatctggtaccctcttcttgcactccacagctgaatttgcataggtactcactttgaatatccttttaactaccccttaggctgcacttttgatcattaatttcctttgaaatgttttctagatttctaacatgctttattaaaaattatgcatttaacctttaaatatatgcctgaatttttcccaagctatttcttaatattcaatattgaagaagataattcttatttaacatctagtttatttgcctaggttggattatctcaagatgcccaggatcaaatgagaaagatgctttgccaaaaagaatctaattacatccgtcttaaaagggctaaaatggacaagtctatgtttgtgaagataaagacactaggaataggagcatttggtgaagtctgtctagcaagaaaagtagatactaaggctttgtatgcaacaaaaactcttcgaaagaaagatgttcttcttcgaaatcaagtcgctcatgttaaggctgagagagatatcctggctgaagctgacaatgaatgggtagttcgtctatattattcattccaagataaggacaatttatactttgtaatggactacattcctgggggtgatatgatgagcctattaattagaatgggcatctttccagaaagtctggcacgattctacatagcagaacttacctgtgcagttgaaagtgttcataaaatgggttttattcatagagatattaaacctgataatattttgattgatcgtgatggtcatattaaattgactgactttggcctctgcactggcttcagatggacacacgattctaagtactatcagagtggtgaccatccacggcaagatagcatggatttcagtaatgaatggggggatccctcaagctgtcgatgtggagacagactgaagccattagagcggagagctgcacgccagcaccagcgatgtctagcacattctttggttgggactcccaattatattgcacctgaagtgttgctacgaacaggatacacacagttgtgtgattggtggagtgttggtgttattctttttgaaatgttggtgggacaacctcctttcttggcacaaacaccattagaaacacaaatgaaggttatcaactggcaaacatctcttcacattccaccacaagctaaactcagtcctgaagcttctgatcttattattaaactttgccgaggacccgaagatcgcttaggcaagaatggtgctgatgaaataaaagctcatccattttttaaaacaattgacttctccagtgacctgagacagcagtctgcttcatacattcctaaaatcacacacccaacagatacatcaaattttgatcctgttgatcctgataaattatggagtgatgataacgaggaagaaaatgtaaatgacactctcaatggatggtataaaaatggaaagcatcctgaacatgcattctatgaatttaccttccgaaggttttttgatgacaatggctacccatataattatccgaagcctattgaatatgaatacattaattcacaaggctcagagcagcagtcggatgaagatgatcaaaacacaggctcagagattaaaaatcgcgatctagtatatgtttaacacactagtaaataaatgtaatgaggatttgtaaaagggcctgaaatgcgaggtgttttgaggttctgagagtaaaattatgcaaatatgacagagctatatatgtgtgctctgtgtacaatattttattttcctaaattatgggaaatccttttaaaatgttaatttattccagccgtttaaatcagtatttagaaaaaaattgttataaggaaagtaaattatgaactgaatattatagtcagttcttggtacttaaagtacttaaaataagtagtgctttgtttaaaaggagaaacctggtatctatttgtatatatgctaaataattttaaaatacaagagtttttgaaatttttttgaaagacagttttagttttatcttgctttaaccaaatatgaaacataccccctattttacagagctcttttttcccctcataaccttgtttttggtagaaaataagctagagaaattaagccatcgtgttggtgagtgttcctaggctaatgataatctgtataattcacatcctgaaactaaggaatacagggttgaaaaaatattaatatgtttgtcagaaggaaaaataatgcatttattttcccccccaccccccgccccatggaatatttaatctatttaatcttcttgcatttatttctcaagaattactggctttaaaagaagccaaagcactactagctttttttccatattggtatttttgatgctgcttccaattttaaaagggaacaaagctgccataaatcgaaatgttcaatactaaaagctaaaatatttctcaccatcg

SEQ ID NO: 301898 - DNA, 504 bp, Homo sapiens
cctattaattagaatgggcatctttccagaaagtctggcacgattctacatagcagaacttacctgtgcagttgaaagtgttcataaaatgggttttattcatagagatattaaacctgataatattttgattgatcgtgatggtcatattaaattgactgactttggcctctgcactggcttcagatggacacacgattctaagtactatcagagtggtaagtaaactcataaaatttattttagtttgttcataataatgtaatttattgatgtagtaaaatataagatggtatcatcactggatgagagccagaagatgtgggtcaggtcttgattctgttggataaacttgggtgactccattaggcacttagacttatgaaatgaaagaatgtgctagacttgattgtttagacttatgaaatgaaagaatgtgctagacttgattgtttctaaatattattaacatttttgagtcacaccttttacattttatttgaa

SEQ ID NO: 301899 - DNA, 689 bp, Homo sapiens
gagccttggagaccagaccaacagtaacaccaagggcaggtgggcaggcctccgccctcctcccctactccagggcccactgcagcctcagcccaggagccaccagatctcccaacaccatggtccgataccgcgtgaggagcctgagcgaacgctcgcacgaggtgtacaggcagcagttgcatgggcaagagcaaggacaccacggccaagaggagcaagggctgagcccggagcacgtcgaggtctacgagaggacccatggccagtctcactataggcgcagacactgctctcgaaggaggctgcaccggatccacaggcggcagcatcgctcctgcagaaggcgcaaaagacgctcctgcaggcaccggaggaggcatcgcagaggctgcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaatgagcaaaagtcacctgcccaataaagcttgacaagaca

SEQ ID NO: 301900 - DNA, 1105 bp, Homo sapiens
gagccttggagaccagaccaacagtaacaccaagggcaggtgggcaggcctccgccctcctcccctactccagggcccactgcagcctcagcccaggagccaccagatctcccaacaccatggtccgataccgcgtgaggagcctgagcgaacgctcgcacgaggtgtacaggcagcagttgcatgggcaagagcaaggacaccacggccaagaggagcaagggctgagcccggagcacgtcgaggtctacgagaggacccatggccagtctcactataggcgcagacactgctctcgaaggaggctgcaccggatccacaggcggcagcatcgctcctgcagaaggcgcaaaagacgctcctgcaggcaccggaggaggcatcgcagaggctgcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaatgagcaaaagtcacctgcccaataaagcttgacaagacaaaaaaaaacaaaataaaaaaaaaaaagggggggggcgcggaccataaagatatttcccagaggggcaccaaattataacgtagtcacccccaggttttttttgtcaccgcgtcggccccatattgagagagcgcgtataataaagcaaggcacataggaaggatttaaccacgtttcggtgtgtgaaaaactgggtgctatgtctgagggaaacacttggtggaagagagacgctacattgtggggggggcggcacaattgtgtggacccagttcacctagaagaaaattaagagcctaagaggggaagtcatgaaccgttgaagagtgtatatgcgttgttgagacgacgggtgaattgtattgtgttgtggaagaatttgcgaaacgagatgttgtataagagaaatttttgcg

SEQ ID NO: 301901 - DNA, 1173 bp, Homo sapiens
gagccttggagaccagaccaacagtaacaccaagggcaggtgggcaggcctccgccctcctcccctactccagggcccactgcagcctcagcccaggagccaccagatctcccaacaccatggtccgataccgcgtgaggagcctgagcgaacgctcgcacgaggtgtacaggcagcagttgcatgggcaagagcaaggacaccacggccaagaggagcaagggctgagcccggagcacgtcgaggtctacgagaggacccatggccagtctcactataggcgcagacactgctctcgaaggaggctgcaccggatccacaggcggcagcatcgctcctgcagaaggcgcaaaagacgctcctgcaggcaccggaggaggcatcgcagaggctgcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaatgagcaaaagtcacctgcccaataaagcttgacaagacaaaaaaaaaaaaaaaaaaaaaaaaaaaaaaaaaaaaaaaaaaaaaaaaaaaaaaaaaaacaaaataaaaaaaaaaaaaaaaaaaaaaaacaaagaagaagaggaagaaaagaacaacgacacacagcacacaccgcacacgaaacacacagccgacaccacgcagacgacgcactagcccgcgcgcgcgcgaccacacgcccaacagcgcgacccgagccccagcaccagccctgccaccgcgccccgacggcgcgcgccgccgcgcgcgcgcgagacgcggagaccgaggaccgcgagacacgaaggacaatcgacggcagacacaccagaacaagacatacgcactgcaaaccacgcaccacaacagagcagcaagaaagcggccaacgaaaaagacacaagacacgccaagaccaaagacaggagagcacagaaacaccggcaagaaagcacacagcagccgcagggagacataacacaaat

SEQ ID NO: 301902 - DNA, 710 bp, Homo sapiens
cagttagtcatattaacattggtaaacgagtgtccggccgaatcttgggatacaaggcaggtgggcaggcctccgccctcctcccctactccagggcccactgcagcctcagcccaggagccaccagatctcccaacaccatggtccgataccgcgtgaggagcctgagcgaacgctcgcacgaggtgtacaggcagcagttgcatgggcaagagcaaggacaccacggccaagaggagcaagggctgagcccggagcacgtcgaggtctacgagaggacccatggccagtctcactataggcgcagacactgctctcgaaggaggctgcaccggatccacaggcggcagcatcgctcctgcagaaggcgcaaaagacgctcctgcaggcaccggaggaggcatcgcagaggctgcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaatgagcaaaagtcacctgcccaataaagcttgacaagaca

SEQ ID NO: 301903 - DNA, 831 bp, Homo sapiens
cagttagtcatattaacattggtaaacgagtgtccggccgaatcttgggatacaaggcaggtgggcaggcctccgccctctgcagcctcagcccaggagccaccagatctcccaacaccatggtccgataccgcgtgaggagcctgagcgaacgctcgcacgaggtgtacaggcagcagttgcatgggcaagagcaaggacaccacggccaagaggagcaagggctgagcccggagcacgtcgaggtctacgagaggacccatggccagtctcactataggcgcagacactgctctcgaaggaggctgcaccggatccacaggcggcagcatcgctcctgcagaaggcgcaaaagacgctcctgcaggcaccggaggaggcatcgcagaggctgcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaatgagcaaaagtcacctgcccaataaagcttgacaagacaaagactcagaagaacttgtgataatatatgaaccagacgaaaacagtgcgcaacctcaaggtggtaccccgagaggaaccaccgaagcggcacgccgaaacttccgacacagaatggccaaaatggggtccctataaacgac

SEQ ID NO: 301904 - DNA, 128 bp, Homo sapiens
atcaaatgctcaagccctgagttgccgccgagaagcccacaagatctgagtgaaatgagcaaaagtcacctgcccaataaagcttgacaagacactcgctggcctgtcgggttttctttgcacgaatc

SEQ ID NO: 301905 - DNA, 1469 bp, Homo sapiens
aggactgagatcccagaacatgccacaccaagaagacatgtcccaaggggcagtggagccacagccaccagaagggacctggccctgtcggacctgctgaagctagccgtggagtgcaggggctttgttggtctggctgctaaccaaagggtggctaatgggaccctttccaggggcctctaggggatttcagtgggggcttgcttcgaggctctattaccactggactgtttaccaagagcctcagcctgacagagatgggaagagacgagtgagcatttctgacccaacacccccactgcagagttggggaaacatttacccaagataggaggaataaaaaggaaaaaaattgaatttatttccaaaaaacataccaaggtggacaagataggaaacaatacaatttatattacagttttattattatttaaaaattttatattaacaaaatgagatgggatctgcctatgttgcccaggctggtcttcaactcctgggctcaatctcctcggcctccgaaagtgtgattacaggcgtgagccaccgcacccggcccatattacagtttcatagtgtttttgattactcgtggtaggagaaatgtgtcttctttgcacttggggtctcaacgtctcagtcctgccctatgccccgagaccccaagaggctttcccaaggtcaggcagggaatccgcagagaggcagggctggactccagcatcctgactccccagttcgtgctctgtgctgcagagacctgttgcgtaacactgagtaactgtggattgtctaaccttttatgaaatttccagctggtcttttgctaccggccagcagtccagttggtgggagtgatgatgccggtcttctgggacgtccagtggacagattttccccaggtttctggatgcagccccaacaagcaaaagtgctacactcctgcaccgggaacactgacacaggggtcacgaaaatgctaaaacaagacgtgcaagaattgttgcgctccgcacacgtaacaagggctctgcctccccctcccccaatcttcgccctggtggccaggccctgggctccgccccttccccaccagaccgggggaggggtcctcctcggcatggaggtaggggatgctaggctgctggagacgcccgcagaaagaggcgggatggcggggcggatgctggcggcccgggtctggccacctgggtcagctgcacgcccccgccccgggctggccggacctcgtagcccaggtcccaccacgccgtgaagtttgcggaaagttttgcagttgcttccccgcccgcgccagcgggggagttgtgacgcagcgtctggggatcctggccgggacagaagagagggaaggcgaggcggggagagactgggaaacagagcagcaagagaaagggcgcacgctggggtcctcctggacccggcgtgtcctcctctccgccacccct

SEQ ID NO: 301906 - DNA, 1013 bp, Homo sapiens
  misc_feature (979)..(979): n is a, c, g, or t
  misc_feature (1002)..(1002): n is a, c, g, or t
  misc_feature (1011)..(1012): n is a, c, g, or t
aggactgagatcccagaacatgccacaccaagaagacatgtcccaaggggcagtggagccacagccaccagaagggacctggccctgtcggacctgctgaagctagccgtggagtgcaggggctttgttggtctggctgctaaccaaagggtggctaatgggaccctttccaggggcctctaggggatttcagtgggggcttgcttcgaggctctattaccactggactgtttaccaagagcctcagcctgacagagatgggaagagacgagtgagcatttctgacccaacacccccactgcagagttggggaaacatttacccaagataggaggaataaaaaggaaaaaaattgaatttatttccaaaaaacataccaaggtggacaagataggaaacaatacaatttatattacagttttattattatttaaaaattttatattaacaaaatgagatgggatctgcctatgttgcccaggctggtcttcaactcctgggctcaatctcctcggcctccgaaagtgtgattacaggcgtgagccaccgcacccggcccatattacagtttcatagtgtttttgattactcgtggtaggagaaatgtgtcttctttgcacttggggtctcaacgtctcagtcctgccctatgccccgagaccccaagaggctttcccaaggtcaggcagggaatccgcagagaggcagggctggactccagcatcctgactccccagttcgtgctctgtgctgcagagacctgttgcgtaacactgagtaactgtggattgtctaaccttttatgaaatttccagctggtcttttgctaccggccagcagtccagttggtgggagtgatgatgccggtcttctgggacgtccagtggacagattttccccaggtttctggatgcagccccaacaagcaaaagtgctacactcctgcaccgggaacactgacacaggggtcacgaaaatntcctcgcactcctgccttccccncgtgccgannt

SEQ ID NO: 301907 - DNA, 461 bp, Homo sapiens
ctggtggagacctggtctttgcctggtgtgtggccttctcctggccttgtgcctgggaacggggtgagggaagcagagcccagcctgaaccctgaccccttccctgtagacccctccctgagcccgtccccagcagcgctgccccccgccccgggcactgagctctcctacctcaacggcaccttccggctgcttcagaagccgctgcgctggcacgatgccctcctgctgtgtgagagccacaatgccagcctggcctacgtgcccgacccctacacccaggccttcctcacgcaggctcatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagagaaggtt

SEQ ID NO: 301908 - DNA, 380 bp, Homo sapiens
cctctgttgatgtttcttacggacttccagctcattagtgaaaaaataagagtcaacatctttcttcgcagggtgagaaagaaacacccagagattttatttggcttttaattagcgattattccagtgctagagtgaatggtctcagaaatattaaatgttcagtttgaattagtttattacagaaaagcttcttggtttgcagtatgaaatctgcaactaaagtttacactttttacttaggcagaaaatatatactcgaagacatggccctttctctgtagttgattttttaaatgtgccattattgtttttaaaaaaaaaggaaaaaagaaaagcaaacaaataaaacacctttaagaggcttgaaagagaaggtt

SEQ ID NO: 301909 - DNA, 5716 bp, Homo sapiens
gtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacgaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtaacgactgcgagaccttctgggacaaggaccagctgactgacagctgctaccagtttaacttccagtccacgctgtcgtggagggaggcctgggccagctgcgagcagcagggtgcggatctgctgagcatcacggagatccacgagcagacctacatcaacggcctcctcactgggtacagctccaccctgtggatcggcttgaatgacttggacacgagcggaggctggcagtggtcggacaactcgcccctcaagtacctcaactgggagagtgaccagccggacaaccccagtgaggagaactgtggagtgatccgcactgagtcctcgggcggctggcagaaccgtgactgcagcatcgcgctgccctatgtgtgcaagaagaagcccaacgccacggccgagcccacccctccagacaggtgggccaatgtgaaggtggagtgcgagccgagctggcagcccttccagggccactgctaccgcctgcaggccgagaagcgcagctggcaggagtccaagaaggcatgtctacggggcggtggcgacctggtcagcatccacagcatggcggagctggaattcatcaccaagcagatcaagcaagaggtggaggagctgtggatcggcctcaacgatttgaaactgcagatgaattttgagtggtctgacgggagccttgtgagcttcacccactggcacccctttgagcccaacaacttccgggacagtctggaggactgtgtcaccatctggggcccggaaggccgctggaacgacagtccctgtaaccagtccttgccatccatctgcaagaaggcaggccagctgagccagggggccgccgaggaggaccatggctgccggaagggttggacgtggcacagcccatcctgctactggctgggagaagaccaagtgacctacagtgaggcccggcgcctgtgcactgaccatggctctcagctggtcaccatcaccaacaggttcgagcaggccttcgtcagcagcctcatctacaactgggagggcgagtacttctggacggccctgcaggacctcaacagcaccggctccttcttctggctcagtggggatgaagtcatgtacacccactggaaccgggaccagcccgggtacagccgtgggggctgcgtggcgctggccactggcagcgccatggggctgtgggaggtgaagaactgtacctcgttccgggcccgctacatctgccggcagagcctgggcactccagtgacgccggagctgccggggccagatcccacgcccagcctcactggctcctgtccccagggctgggcctcggacaccaaactccggtattgctataaggtgttcagctcagagcggctgcaggacaagaagagctgggtccaggcccagggggcctgccaggagctgggggcccagctgctgagcctggccagctacgaggaggagcactttgtggccaacatgctcaacaagatcttcggtgaatcagaacccgagatccacgagcagcactggttctggatcggcctgaaccgtcgggatcccagagggggtcagagttggcgctggagcgacggcgtagggttctcttaccacaatttcgaccggagccggcacgacgacgacgacatccgaggctgtgcggtgctggacctggcctccctgcagtgggtggccatgcagtgcgacacacagctggactggatctgcaagatccccagaggtacggacgtgcgggagcccgacgacagccctcaaggccgacgggaatggctgcgcttccaggaggccgagtacaagttctttgagcaccactccacgtgggcgcaggcgcagcgcatctgcacgtggttccaggccgagctgacctccgtgcacagccaggcggagctagacttcctgagccacaacttgcagaagttctcccgggcccaggagcagcactggtggatcggcctgcacacctctgagagcgatcgggcgcttcagatggacagatggttccattataaacttcatctcctgggcaccaggcaaacctcggcctgtcggcaaggacaagaagtgcgtgtacatgacagccagccgagaggactggggggaccagaggtgcctgacagccttgccctacatctgcaagcgcagcaacgtcaccaaagaaacgcagcccccagacctgccaactacagccctggggggctgcccctctgactggatccagttcctcaacaagtgttttcaggtccagggccaggaaccccagagccgggtgaagtggtcagaggcacagttctcctgtgaacagcaagaggcccagctggtcaccatcacaaaccccttagagcaagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccgaccagctgtgcggtggtcctgcacagcccctcagcccacttcactggccgctgggacgatcggagctgcacggaggagacccatggcttcatctgccagaagggcacggacccctccctgagcccgtccccagcagcgctgccccccgccccgggcactgagctctcctacctcaacggcaccttccggctgcttcagaagccgctgcgctggcacgatgccctcctgctgtgtgagagccacaatgccagcctggcctacgtgcccgacccctacacccaggccttcctcacgcaggctgcccgagggctgcgcacgccgctctggattgggctggctggcgaggagggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtgggccccctcctccccgaagaataagctaccatggcagctgtccccagggactggcagactccgcgtggattcccttccgggagcactgctattctttccacatggagctgctgctgggccacaaggaggcgcgacagcgctgccagagagcgggtggggccgtcctgtctatcctggatgagatggagaatgtgtttgtctgggagcacctgcagagctatgagggccagagtcggggcgcctggctgggcatgaacttcaaccccaaaggaggcactctggtctggcaggacaacacagctgtgaactactccaactgggggcccccgggcttgggccccagcatgctgagccacaacagctgctactggattcagagcaacagcgggctatggcgccccggcgcttgcaccaacatcaccatgggtgtcgtctgcaagcttcctcgtgctgagcagagcagcttctccccatcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagagaaggtt

SEQ ID NO: 301910 - DNA, 5628 bp, Homo sapiens
gtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacgaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtaacgactgcgagaccttctgggacaaggaccagctgactgacagctgctaccagtttaacttccagtccacgctgtcgtggagggaggcctgggccagctgcgagcagcagggtgcggatctgctgagcatcacggagatccacgagcagacctacatcaacggcctcctcactgggtacagctccaccctgtggatcggcttgaatgacttggacacgagcggaggctggcagtggtcggacaactcgcccctcaagtacctcaactgggagagtgaccagccggacaaccccagtgaggagaactgtggagtgatccgcactgagtcctcgggcggctggcagaaccgtgactgcagcatcgcgctgccctatgtgtgcaagaagaagcccaacgccacggccgagcccacccctccagacaggtgggccaatgtgaaggtggagtgcgagccgagctggcagcccttccagggccactgctaccgcctgcaggccgagaagcgcagctggcaggagtccaagaaggcatgtctacggggcggtggcgacctggtcagcatccacagcatggcggagctggaattcatcaccaagcagatcaagcaagaggtggaggagctgtggatcggcctcaacgatttgaaactgcagatgaattttgagtggtctgacgggagccttgtgagcttcacccactggcacccctttgagcccaacaacttccgggacagtctggaggactgtgtcaccatctggggcccggaaggccgctggaacgacagtccctgtaaccagtccttgccatccatctgcaagaaggcaggccagctgagccagggggccgccgaggaggaccatggctgccggaagggttggacgtggcacagcccatcctgctactggctgggagaagaccaagtgacctacagtgaggcccggcgcctgtgcactgaccatggctctcagctggtcaccatcaccaacaggttcgagcaggccttcgtcagcagcctcatctacaactgggagggcgagtacttctggacggccctgcaggacctcaacagcaccggctccttcttctggctcagtggggatgaagtcatgtacacccactggaaccgggaccagcccgggtacagccgtgggggctgcgtggcgctggccactggcagcgccatggggctgtgggaggtgaagaactgtacctcgttccgggcccgctacatctgccggcagagcctgggcactccagtgacgccggagctgccggggccagatcccacgcccagcctcactggctcctgtccccagggctgggcctcggacaccaaactccggtattgctataaggtgttcagctcagagcggctgcaggacaagaagagctgggtccaggcccagggggcctgccaggagctgggggcccagctgctgagcctggccagctacgaggaggagcactttgtggccaacatgctcaacaagatcttcggtgaatcagaacccgagatccacgagcagcactggttctggatcggcctgaaccgtcgggatcccagagggggtcagagttggcgctggagcgacggcgtagggttctcttaccacaatttcgaccggagccggcacgacgacgacgacatccgaggctgtgcggtgctggacctggcctccctgcagtgggtggccatgcagtgcgacacacagctggactggatctgcaagatccccagaggtacggacgtgcgggagcccgacgacagccctcaaggccgacgggaatggctgcgcttccaggaggccgagtacaagttctttgagcaccactccacgtgggcgcaggcgcagcgcatctgcacgtggttccaggccgagctgacctccgtgcacagccaggcggagctagacttcctgagccacaacttgcagaagttctcccgggcccaggagcagcactggtggatcggcctgcacacctctgagagcgatcgggcgcttcagatggacagatggttccattataaacttcatctcctgggcaccaggcaaacctcggcctgtcggcaaggacaagaagtgcgtgtacatgacagccagccgagaggactggggggaccagaggtgcctgacagccttgccctacatctgcaagcgcagcaacgtcaccaaagaaacgcagcccccagacctgccaactacagccctggggggctgcccctctgactggatccagttcctcaacaagtgttttcaggtccagggccaggaaccccagagccgggtgaagtggtcagaggcacagttctcctgtgaacagcaagaggcccagctggtcaccatcacaaaccccttagagcaagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccgaccagctgtgcggtggtcctgcacagcccctcagcccacttcactggccgctgggacgatcggagctgcacggaggagacccatggcttcatctgccagaagggcacggacccctccctgagcccgtccccagcagcgctgccccccgccccgggcactgagctctcctacctcaacggcaccttccggctgcttcagaagccgctgcgctggcacgatgccctcctgctgtgtgagagccacaatgccagcctggcctacgtgcccgacccctacacccaggccttcctcacgcaggctgcccgagggctgcgcacgccgctctggattgggctggctggcgaggagggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtgggccccctcctccccgaagaataagctaccatggcagctgtccccagggactggcagactccgcgtggattcccttccgggagcactgctattctttccacatggagctgctgctgggccacaaggaggcgcgacagcgctgccagagagcgggtggggccgtcctgtctatcctggatgagatggagaatgtgtttgtctgggagcacctgcagagctatgagggccagagtcggggcgcctggctgggcatgaacttcaaccccaaaggaggcactctggtctggcaggacaacacagctgtgaactactccaactgggggcccccgggcttgggccccagcatgctgagccacaacagctgctactggattcagagcaacagcgggctatggcgccccggcgcttgcaccaacatcaccatgggtgtcgtctgcaagcttcctcgtgctgagcagagcagcttctccccatcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgcctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagagaaggtt

SEQ ID NO: 301911 - DNA, 3267 bp, Homo sapiens
ggcctggcacggtgcctgcctgggtccggtgtgcctgcaggctcgcctgctgccgcctggctctgccccggccctgccgcgcccgcctccggggcctggcgtgcagcctctgcctggccgccgctcccacgcccgcgctgctcctgcaggccgacgggaatggctgcgcttccaggaggccgagtacaagttctttgagcaccactccacgtgggcgcaggcgcagcgcatctgcacgtggttccaggccgagctgacctccgtgcacagccaggcggagctagacttcctgagccacaacttgcagaagttctcccgggcccaggagcagcactggtggatcggcctgcacacctctgagagcgatcgggcgcttcagatggacagatggttccattataaacttcatctcctgggcaccaggcaaacctcggcctgtcggcaaggacaagaagtgcgtgtacatgacagccagccgagaggactggggggaccagaggtgcctgacagccttgccctacatctgcaagcgcagcaacgtcaccaaagaaacgcagcccccagacctgccaactacagccctggggggctgcccctctgactggatccagttcctcaacaagtgttttcaggtccagggccaggaaccccagagccgggtgaagtggtcagaggcacagttctcctgtgaacagcaagaggcccagctggtcaccatcacaaaccccttagagcaagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccgaccagctgtgcggtggtcctgcacagcccctcagcccacttcactggccgctgggacgatcggagctgcacggaggagacccatggcttcatctgccagaagggcacggacccctccctgagcccgtccccagcagcgctgccccccgccccgggcactgagctctcctacctcaacggcaccttccggctgcttcagaagccgctgcgctggcacgatgccctcctgctgtgtgagagccacaatgccagcctggcctacgtgcccgacccctacacccaggccttcctcacgcaggctgcccgagggctgcgcacgccgctctggattgggctggctggcgaggagggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtgggccccctcctccccgaagaataagctaccatggcagctgtccccagggactggcagactccgcgtggattcccttccgggagcactgctattctttccacatggagctgctgctgggccacaaggaggcgcgacagcgctgccagagagcgggtggggccgtcctgtctatcctggatgagatggagaatgtgtttgtctgggagcacctgcagagctatgagggccagagtcggggcgcctggctgggcatgaacttcaaccccaaaggaggcactctggtctggcaggacaacacagctgtgaactactccaactgggggcccccgggcttgggccccagcatgctgagccacaacagctgctactggattcagagcaacagcgggctatggcgccccggcgcttgcaccaacatcaccatgggtgtcgtctgcaagcttcctcgtgctgagcagagcagcttctccccatcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagagaaggtt

SEQ ID NO: 301912 - DNA, 5400 bp, Homo sapiens
gtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacgaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtaacgactgcgagaccttctgggacaaggaccagctgactgacagctgctaccagtttaacttccagtccacgctgtcgtggagggaggcctgggccagctgcgagcagcagggtgcggatctgctgagcatcacggagatccacgagcagacctacatcaacggcctcctcactgggtacagctccaccctgtggatcggcttgaatgacttggacacgagcggaggctggcagtggtcggacaactcgcccctcaagtacctcaactgggagagtgaccagccggacaaccccagtgaggagaactgtggagtgatccgcactgagtcctcgggcggctggcagaaccgtgactgcagcatcgcgctgccctatgtgtgcaagaagaagcccaacgccacggccgagcccacccctccagacaggtgggccaatgtgaaggtggagtgcgagccgagctggcagcccttccagggccactgctaccgcctgcaggccgagaagcgcagctggcaggagtccaagaaggcatgtctacggggcggtggcgacctggtcagcatccacagcatggcggagctggaattcatcaccaagcagatcaagcaagaggtggaggagctgtggatcggcctcaacgatttgaaactgcagatgaattttgagtggtctgacgggagccttgtgagcttcacccactggcacccctttgagcccaacaacttccgggacagtctggaggactgtgtcaccatctggggcccggaaggccgctggaacgacagtccctgtaaccagtccttgccatccatctgcaagaaggcaggccagctgagccagggggccgccgaggaggaccatggctgccggaagggttggacgtggcacagcccatcctgctactggctgggagaagaccaagtgacctacagtgaggcccggcgcctgtgcactgaccatggctctcagctggtcaccatcaccaacaggttcgagcaggccttcgtcagcagcctcatctacaactgggagggcgagtacttctggacggccctgcaggacctcaacagcaccggctccttcttctggctcagtggggatgaagtcatgtacacccactggaaccgggaccagcccgggtacagccgtgggggctgcgtggcgctggccactggcagcgccatggggctgtgggaggtgaagaactgtacctcgttccgggcccgctacatctgccggcagagcctgggcactccagtgacgccggagctgccggggccagatcccacgcccagcctcactggctcctgtccccagggctgggcctcggacaccaaactccggtattgctataaggtgttcagctcagagcggctgcaggacaagaagagctgggtccaggcccagggggcctgccaggagctgggggcccagctgctgagcctggccagctacgaggaggagcactttgtggccaacatgctcaacaagatcttcggtgaatcagaacccgagatccacgagcagcactggttctggatcggcctgaaccgtcgggatcccagagggggtcagagttggcgctggagcgacggcgtagggttctcttaccacaatttcgaccggagccggcacgacgacgacgacatccgaggctgtgcggtgctggacctggcctccctgcagtgggtggccatgcagtgcgacacacagctggactggatctgcaagatccccagaggtacggacgtgcgggagcccgacgacagccctcaaggccgacgggaatggctgcgcttccaggaggccgagtacaagttctttgagcaccactccacgtgggcgcaggcgcagcgcatctgcacgtggttccaggccgagctgacctccgtgcacagccaggcggagctagacttcctgagccacaacttgcagaagttctcccgggcccaggagcagcactggtggatcggcctgcacacctctgagagcgatcgggcgcttcagatggacagatggttccattataaacttcatctcctgggcaccaggcaaacctcggcctgtcggcaaggacaagaagtgcgtgtacatgacagccagccgagaggactggggggaccagaggtgcctgacagccttgccctacatctgcaagcgcagcaacgtcaccaaagaaacgcagcccccagacctgccaactacagccctggggggctgcccctctgactggatccagttcctcaacaagtgttttcaggtccagggccaggaaccccagagccgggtgaagtggtcagaggcacagttctcctgtgaacagcaagaggcccagctggtcaccatcacaaaccccttagagcaagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccgaccagctgtgcggtggtcctgcacagcccctcagcccacttcactggccgctgggacgatcggagctgcacggaggagacccatggcttcatctgccagaagggcacggacccctccctgagcccgtccccagcagcgctgccccccgccccgggcactgagctctcctacctcaacggcaccttccggctgcttcagaagccgctgcgctggcacgatgccctcctgctgtgtgagagccacaatgccagcctggcctacgtgcccgacccctacacccaggccttcctcacgcaggctgcccgagggctgcgcacgccgctctggattgggctggctggcgaggagggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtgggccccctcctccccgaagaataagctaccatggcagctgtccccagggactggcagactccgcgtggattcccttccgggagcactgctattctttccacatggagctgctgctgggccacaaggaggcgcgacagcgctgccagagagcgggtggggccgtcctgtctatcctggatgagatggagaatgtgtttgtctgggagcacctgcagagctatgagggccagagtcggggcgcctggctgggcatgaacttcaaccccaaaggaggcactctggtctggcaggacaacacagctgtgaactactccaactgggggcccccgggcttgggccccagcatgctgagccacaacagctgctactggattcagagcaacagcgggctatggcgccccggcgcttgcaccaacatcaccatgggtgtcgtctgcaagcttcctcgtgctgagcagagcagcttctccccatcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctagcctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagagaaggtt

SEQ ID NO: 301913 - DNA, 4462 bp, Homo sapiens
gtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacgaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtaacgactgcgagaccttctgggacaaggaccagctgactgacagctgctaccagtttaacttccagtccacgctgtcgtggagggaggcctgggccagctgcgagcagcagggtgcggatctgctgagcatcacggagatccacgagcagacctacatcaacggcctcctcactgggtacagctccaccctgtggatcggcttgaatgacttggacacgagcggaggctggcagtggtcggacaactcgcccctcaagtacctcaactgggagagtgaccagccggacaaccccagtgaggagaactgtggagtgatccgcactgagtcctcgggcggctggcagaaccgtgactgcagcatcgcgctgccctatgtgtgcaagaagaagcccaacgccacggccgagcccacccctccagacaggtgggccaatgtgaaggtggagtgcgagccgagctggcagcccttccagggccactgctaccgcctgcaggccgagaagcgcagctggcaggagtccaagaaggcatgtctacggggcggtggcgacctggtcagcatccacagcatggcggagctggaattcatcaccaagcagatcaagcaagaggtggaggagctgtggatcggcctcaacgatttgaaactgcagatgaattttgagtggtctgacgggagccttgtgagcttcacccactggcacccctttgagcccaacaacttccgggacagtctggaggactgtgtcaccatctggggcccggaaggccgctggaacgacagtccctgtaaccagtccttgccatccatctgcaagaaggcaggccagctgagccagggggccgccgaggaggaccatggctgccggaagggttggacgtggcacagcccatcctgctactggctgggagaagaccaagtgacctacagtgaggcccggcgcctgtgcactgaccatggctctcagctggtcaccatcaccaacaggttcgagcaggccttcgtcagcagcctcatctacaactgggagggcgagtacttctggacggccctgcaggacctcaacagcaccggctccttcttctggctcagtggggatgaagtcatgtacacccactggaaccgggaccagcccgggtacagccgtgggggctgcgtggcgctggccactggcagcgccatggggctgtgggaggtgaagaactgtacctcgttccgggcccgctacatctgccggcagagcctgggcactccagtgacgccggagctgccggggccagatcccacgcccagcctcactggctcctgtccccagggctgggcctcggacaccaaactccggtattgctataaggtgttcagctcagagcggctgcaggacaagaagagctgggtccaggcccagggggcctgccaggagctgggggcccagctgctgagcctggccagctacgaggaggagcactttgtggccaacatgctcaacaagatcttcggtgaatcagaacccgagatccacgagcagcactggttctggatcggcctgaaccgtcgggatcccagagggggtcagagttggcgctggagcgacggcgtagggttctcttaccacaatttcgaccggagccggcacgacgacgacgacatccgaggctgtgcggtgctggacctggcctccctgcagtgggtggccatgcagtgcgacacacagctggactggatctgcaagatccccagaggtacggacgtgcgggagcccgacgacagccctcaaggccgacgggaatggctgcgcttccaggaggccgagtacaagttctttgagcaccactccacgtgggcgcaggcgcagcgcatctgcacgtggttccaggccgagctgacctccgtgcacagccaggcggagctagacttcctgagccacaacttgcagaagttctcccgggcccaggagcagcactggtggatcggcctgcacacctctgagagcgatcgggcgcttcagatggacagatggttccattataaacttcatctcctgggcaccaggcaaacctcggcctgtcggcaaggacaagaagtgcgtgtacatgacagccagccgagaggactggggggaccagaggtgcctgacagccttgccctacatctgcaagcgcagcaacgtcaccaaagaaacgcagcccccagacctgccaactacagccctggggggctgcccctctgactggatccagttcctcaacaagtgttttcaggtccagggccaggaaccccagagccgggtgaagtggtcagaggcacagttctcctgtgaacagcaagaggcccagctggtcaccatcacaaaccccttagagcaagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccgaccagctgtgcggtggtcctgcacagcccctcagcccacttcactggccgctgggacgatcggagctgcacggaggagacccatggcttcatctgccagaagggcacggacccctccctgagcccgtccccagcagcgctgccccccgccccgggcactgagctctcctacctcaacggcaccttccggctgcttcagaagccgctgcgctggcacgatgccctcctgctgtgtgagagccacaatgccagcctggcctacgtgcccgacccctacacccaggccttcctcacgcaggctgcccgagggctgcgcacgccgctctggattgggctggctggcgaggagggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtgggccccctcctccccgaagaataagctaccatggcagctgtccccagggactggcagactccgcgtggattcccttccgggagcactgctattctttccacatggagctgctgctgggccacaaggaggcgcgacagcgctgccagagagcgggtggggccgtcctgtctatcctggatgagatggagaatgtgtttgtctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagagaaggtt

SEQ ID NO: 301914 - DNA, 2847 bp, Homo sapiens
gtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacgaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtaacgactgcgagaccttctgggacaaggaccagctgactgacagctgctaccagtttaacttccagtccacgctgtcgtggagggaggcctgggccagctgcgagcagcagggtgcggatctgctgagcatcacggagatccacgagcagacctacatcaacggcctcctcactgggtacagctccaccctgtggatcggcttgaatgacttggacacgagcggaggctggcagtggtcggacaactcgcccctcaagtacctcaactgggagagtgaccagccggacaaccccagtgaggagaactgtggagtgatccgcactgagtcctcgggcggctggcagaaccgtgactgcagcatcgcgctgccctatgtgtgcaagaagaagcccaacgccacggccgagcccacccctccagacaggtgggccaatgtgaaggtggagtgcgagccgagctggcagcccttccagggccactgctaccgcctgcaggccgagaagcgcagctggcaggagtccaagaaggcatgtctacggggcggtggcgacctggtcagcatccacagcatggcggagctggaattcatcaccaagcagatcaagcaagaggtggaggagctgtggatcggcctcaacgatttgaaactgcagatgaattttgagtggtctgacgggagccttgtgagcttcacccactggcacccctttgagcccaacaacttccgggacagtctggaggactgtgtcaccatctggggcccggaaggccgctggaacgacagtccctgtaaccagtccttgccatccatctgcaagaaggcaggccagctgagccagggggccgccgaggaggaccatggctgccggaagggttggacgtggcacagcccatcctgctactggctgggagaagaccaagtgacctacagtgaggcccggcgcctgtgcactgaccatggctctcagctggtcaccatcaccaacaggttcgagcaggccttcgtcagcagcctcatctacaactgggagggcgagtacttctggacggccctgcaggacctcaacagcaccggctccttcttctggctcagtggggatgaagtcatgtacacccactggaaccgggaccagcccgggtacagccgtgggggctgcgtggcgctggccactggcagcgccatggggctgtgggaggtgaagaactgtacctcgttccgggcccgctacatctgccggcagagcctgggcactccagtgacgccggagctgccggggccagatcccacgcccagcctcactggctcctgtccccagggctgggcctcggacaccaaactccggtattgctataaggtgttcagctcagagcggctgcaggacaagaagagctgggtccaggcccagggggcctgccaggagctgggggcccagctgctgagcctggccagctacgaggaggagcactttgtggccaacatgctcaacaagatcttcggtgaatcagaacccgagatccacgagcagcactggttctggatcggcctgaaccgtcgggatcccagagggggtcagagttggcgctggagcgacggcgtagggttctcttaccacaatttcgaccggagccggcacgacgacgacgacatccgaggctgtgcggtgctggacctggcctccctgcagtgggtggccatgcagtgcgacacacagctggactggatctgcaagatccccagaggtacggacgtgcgggagcccgacgacagccctcaaggccgacgggaatggctgcgcttccaggaggccgagtacaagttctttgagcaccactccacgtgggcgcaggcgcagcgcatctgcacgtggttccaggccgagctgacctccgtgcacagccaggcggagctagacttcctgagccacaacttgcagaagttctcccgggcccaggagcagcactggtggatcggcctgcacacctctgagagcgatcgggcgcttcaggcggaacccaggcaggcag

SEQ ID NO: 301915 - DNA, 1079 bp, Homo sapiens
gtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacgaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagagaaggtt

SEQ ID NO: 301916 - DNA, 2830 bp, Homo sapiens
gtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacgaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtaacgactgcgagaccttctgggacaaggaccagctgactgacagctgctaccagtttaacttccagtccacgctgtcgtggagggaggcctgggccagctgcgagcagcagggtgcggatctgctgagcatcacggagatccacgagcagacctacatcaacggcctcctcactgggtacagctccaccctgtggatcggcttgaatgacttggacacgagcggaggctggcagtggtcggacaactcgcccctcaagtacctcaactgggagagtgaccagccggacaaccccagtgaggagaactgtggagtgatccgcactgagtcctcgggcggctggcagaaccgtgactgcagcatcgcgctgccctatgtgtgcaagaagaagcccaacgccacggccgagcccacccctccagacaggtgggccaatgtgaaggtggagtgcgagccgagctggcagcccttccagggccactgctaccgcctgcaggccgagaagcgcagctggcaggagtccaagaaggcatgtctacggggcggtggcgacctggtcagcatccacagcatggcggagctggaattcatcaccaagcagatcaagcaagaggtggaggagctgtggatcggcctcaacgatttgaaactgcagatgaattttgagtggtctgacgggagccttgtgagcttcacccactggcacccctttgagcccaacaacttccgggacagtctggaggactgtgtcaccatctggggcccggaaggccgctggaacgacagtccctgtaaccagtccttgccatccatctgcaagaaggcaggccagctgagccagggggccgccgaggaggaccatggctgccggaagggttggacgtggcacagcccatcctgctactggctgggagaagaccaagtgacctacagtgaggcccggcgcctgtgcactgaccatggctctcagctggtcaccatcaccaacaggttcgagcaggccttcgtcagcagcctcatctacaactgggagggcgagtacttctggacggccctgcaggacctcaacagcaccggctccttcttctggctcagtggggatgaagtcatgtacacccactggaaccgggaccagcccgggtacagccgtgggggctgcgtggcgctggccactggcagcgccatggggctgtgggaggtgaagaactgtacctcgttccgggcccgctacatctgccggcagagcctgggcactccagtgacgccggagctgccggggccagatcccacgcccagcctcactggctcctgtccccagggctgggcctcggacaccaaactccggtattgctataaggtgttcagctcagagcggctgcaggacaagaagagctgggtccaggcccagggggcctgccaggagctgggggcccagctgctgagcctggccagctacgaggaggagcactttgtggccaacatgctcaacaagatcttcggtgaatcagaacccgagatccacgagcagcactggttctggatcggcctgaaccgtcgggatcccagagggggtcagagttggcgctggagcgacggcgtagggttctcttaccacaatttcgaccggagccggcacgacgacgacgacatccgaggctgtgcggtgctggacctggcctccctgcagtgggtggccatgcagtgcgacacacagctggactggatctgcaagatccccagaggtacggacgtgcgggagcccgacgacagccctcaaggccgacgggaatggctgcgcttccaggaggccgagtacaagttctttgagcaccactccacgtgcacatgcgctgcgcctgtccccacgtggagtggtgctcaaagaacttgtactcggcctcctggaagcgcgatccttctagatctcgacctgagggctttcgtccttctcacgcaccttcgtatctcatgggtctcgagtggatccagcctagcggtgtgtcgcactgc

SEQ ID NO: 301917 - DNA, 891 bp, Homo sapiens
gtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacgaggtctacaccatccagggaaactcccacggaaagccgtgcaccatccccttcaaatatgacaaccagtggttccacggctgcaccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagagaaggtt

SEQ ID NO: 301918 - DNA, 1883 bp, Homo sapiens
gtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacgaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtaacgactgcgagaccttctgggacaaggaccagctgactgacagctgctaccagtttaacttccagtccacgctgtcgtggagggaggcctgggccagctgcgagcagcagggtgcggatctgctgagcatcacggagatccacgagcagacctacatcaacggcctcctcactgggtacagctccaccctgtggatcggcttgaatgacttggacacgagcggaggctggcagtggtcggacaactcgcccctcaagtacctcaactgggagagtgaccagccggacaaccccagtgaggagaactgtggagtgatccgcactgagtcctcgggcggctggcagaaccgtgactgcagcatcgcgctgccctatgtgtgcaagaagaagcccaacgccacggccgagcccacccctccagacaggtgggccaatgtgaaggtggagtgcgagccgagctggcagcccttccagggccactgctaccgcctgcaggccgagaagcgcagctggcaggagtccaagaaggcatgtctacggggcggtggcgacctggtcagcatccacagcatggcggagctggaattcatcaccaagcagatcaagcaagaggtggaggagctgtggatcggcctcaacgatttgaaactgcagatgaattttgagtggtctgacgggagccttgtgagcttcacccactggcacccctttgagcccaacaacttccgggacagtctggaggactgtgtcaccatctggggcccggaaggccgctggaacgacagtccctgtaaccagtccttgccatccatctgcaagaaggcaggccagctgagccagggggccgccgaggaggaccatggctgccggaagagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagagaaggtt

SEQ ID NO: 301919 - DNA, 645 bp, Homo sapiens
gtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgcatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagagaaggtt

SEQ ID NO: 301920 - DNA, 826 bp, Homo sapiens
agaaagaggcgggatggcggggcggatgctggcggcccgggtctggccacctgggtcagctgcacgcccccgccccgggctggccggacctcgtagcccaggtcccaccacgccgtgaagtttgcggaaagttttgcagttgcttccccgcccgcgccagcgggggagttgtgacgcagcgtctggggatcctggccgggacagaagagagggaaggcgaggcggggagagactgggaaacagagcagcaagagaaagggcgcacgctggggtcctcctggacccggcgtgtcctcctctccgccacccctttctctccctcccgacgctctagccccagacccgcgcctcctccccttcccctcccacgctgcccacttcccttcccctctacccctcgaaccctcctccccggttctgcgctcctccctccgcccgggctgcctcctccctcctcctccccgggaggcatcacttcgtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccgggtaaggcgctgccaacttggccaacttcagggcccgggcggggggagcgccgaggcgcgggccgctctcgacttttccctccttttcccccctcttttctccaga

SEQ ID NO: 301921 - DNA, 89 bp, Homo sapiens
tcactgcacccagcctttgaccactattctttatgtccttgccacaaagtgggattgaccaaagatgtactgtctggagattaacagtt

SEQ ID NO: 301922 - DNA, 2134 bp, Homo sapiens
atgggaggtgcggcgacagtgtttgacgagagccgaaggaggctgtgggaggtgttggcggcggcggcgcgggcgcctgaggaggaggaggagaagcggatgagatcgtggggctcaccagcgtcccccatggcttctgagtagcgtgggagtggagtcagcaccaagccaggctccccgcgcctgccttgccctcacctgctcctgctctctgccagaggcagcatggtccgcagggcaccatggggcccgacagagtgacagcacgagaactgtgcgagaacgacgacctggccaccagcctcgtcctggacccctacctcggtttccgcacccataagatgaacgtcaggtctatcgctacctccgtgccttcctgccggaaagtggctttaccatcctgccctgcacgcgctactccatggagaccaacggggccaagatcgtgtccactcgtgcttggaaaaagaatgagaagctggagctgctggtgggctgcattgcagagctgcgggaggcagatgaggggctgctgagggccggtgagaatgacttcagcatcatgtactcaacccgcaagcggagtgctcagctgtggctgggcccagccgccttcatcaaccatgactgcaaacccaactgcaagtttgtgcctgcagatgggaacgcagcctgcgtgaaggtgctccgggacattgagcctggggacgaggtgacatgcttctacggcgagggcttcttcggcgagaagaatgagcactgtgaatgccacacctgtgagaggaaaggtgaaggagctttccgaaccaggcctagggagcccgcgttgccaccacggcccctggacaagtaccagctgcgtgagaccaagcggcggctgcagcaaggcctggacagtggcagccgacagggcctgctgggccctcgggcctgcgtgcacccatccccgctgcgccgggacccattctgcgccgcctgccagcccctgcgcctgccagcctgcagcgcccgcccagacacctcacccctctggctccagtggctgcctcagccccagccccgagtgcggccccggaagcgccgacgcccccggccccggagggccccagtgctctccacccaccacgctgcccgcgtctccctgcaccgatggggaggctgtggcccccactgccgcctgcgaggagaggccctggtggccctgggccagcccccccacgcccgctgggcccctcagcaggactggcactgggcccggcgctatgggctgccttacgtggtgcgtgtggaccttcgtcgcctggccccagccccaccagctaccccagcccctgctgggaccccaggccccatcctgatcccgaagcaggccctcgccttcgcccccttctccccacccaagcgcctacggctggtggtcagccacggctccatcgacctggatgtcggcggtgaagagctgtgacaggccggacggggaggcccagcagggagagagggtctctctcctagctgctacccaggacctccagaaggagcccttggacctctgggagggagctgacccttgactccagcatagctctgaccctggaatggggttggtttggacacccccagggatctgagccctgaccctttgtgactgctgacccctgagccacccccactcccacagggagccccggccatttgctgccctccccacccctgccccagcctcaggactgcaggagccatccgcccccctcagccccttcctccccagggagcaaagccataaggggcaggggccaccccacggcatctccccagaagtacaggcctcaggaggaggtggaactgatgtagggggtggcactccccagagactgccctcacgaggggactgggttcgctctcagctctgcagctgtctgcggtggggggaaggttggggggtgtctggaggcatgttcccctcaccaccccccgtgggtctcagggaggccgggtgtgacctcatctttctcatggtgctatcctggtgctattggggtggggagctccctcccctcccccacaccagaaaggggtatgttgggggcttggaagcacttgaactttttattttattaaaaccttgttataagca

SEQ ID NO: 301923 - DNA, 2616 bp, Homo sapiens
atgggaggtgcggcgacagtgtttgacgagagccgaaggaggctgtgggaggtgttggcggcggcggcgcgggcgcctgaggaggaggaggagaagcggatgagatcgtggggctcaccagcgtcccccatggcttctgagtagcgtgggagtggagtcagcaccaagccaggctccccgcgcctgccttgccctcacctgctcctgctctctgccagaggcagcatggtccgcagggcaccatggggcccgacagagtgacagcacgagaactgtgcgagaacgacgacctggccaccagcctcgtcctggacccctacctcggtttccgcacccataagatgaacgtcaggtctatcgctacctccgtgccttcctgccggaaagtggctttaccatcctgccctgcacgcgctactccatggagaccaacggggccaagatcgtgtccactcgtgcttggaaaaagaatgagaagctggagctgctggtgggctgcattgcagagctgcgggaggcagatgaggggctgctgagggccggtgagaatgacttcagcatcatgtactcaacccgcaagcggagtgctcagctgtggctgggcccagccgccttcatcaaccatgactgcaaacccaactgcaagtttgtgcctgcagatgggaacgcagcctgcgtgaaggtgctccgggacattgagcctggggacgaggtgacatgcttctacggcgagggcttcttcggcgagaagaatgagcactgtgaatgccacacctgtgagaggaaaggtgaaggagctttccgaaccaggcctagggagcccgcgttgccaccacggcccctggacaagtaccagctgcgtgagaccaagcggcggctgcagcaaggcctggacagtggcagccgacagggcctgctgggccctcgggcctgcgtgcacccatccccgctgcgccgggacccattctgcgccgcctgccagcccctgcgcctgccagcctgcagcgcccgcccagacacctcacccctctggctccagtggctgcctcagccccagccccgagtgcggccccggaagcgccgacgcccccggccccggagggccccagtgctctccacccaccacgctgcccgcgtctccctgcaccgatggggaggctgtggcccccactgccgcctgcgaggagaggccctggtggccctgggccagcccccccacgcccgctgggcccctcagcaggactggcactgggcccggcgctatgggctgccttacgtggtgcgtgtggaccttcgtcgcctggccccagccccaccagctaccccagcccctgctgggaccccaggccccatcctgatcccgaagcaggccctcgccttcgcccccttctccccacccaagcgcctacggctggtggtcagccacggctccatcgacctggatgtcggcggtgaagagctgtgacaggccggacggggaggcccagcagggagagagggtctctctcctagctgctacccaggacctccagaaggagcccttggacctctgggagggagctgacccttgactccagcatagctctgaccctggaatggggttggtttggacacccccagggatctgagccctgaccctttgtgactgctgacccctgagccacccccactcccacagggagccccggccatttgctgccctccccacccctgccccagcctcaggactgcaggagccatccgcccccctcagccccttcctccccagggagcaaagccataaggggcaggggccaccccacggcatctccccagaagtacaggcctcaggaggaggtggaactgatgtagggggtggcactccccagagactgccctcacgaggggactgggttcgctctcagctctgcagctgtctgcggtggggggaaggttggggggtgtctggaggcatgttcccctcaccaccccccgtgggtctcagggaggccgggtgtgacctcatctttctcatggtgctatcctggtgctattggggtggggagctccctcccctcccccacaccagaaaggggtatgttgggggcttggaagcacttgaactttttattttattaaaaccttgttataagcagcacccttggcggttttttgttttggcttatgttttgaagggatgtgaggagggtgagaccctcagctgtgctgatgagagggggaggaggcaacacaggccttcagccctgagagctgtcgggagagggatttgggagcgtgatggactaggggactgaggctggagccccatccccactcaggctgtgcttgtaaaaatgccttgagacccatactctcctaggagtgggtcctcccattttccaggcgaggtcaacatcgtttagcaagcagagtgacttgccaaggccacgtggggacttgagggcccttctcccttctcgcgcttctcaatgagatgcccctcccacatctcactccaaacggagagagactgctgggggcctggctgagtgagggtgtgggggctgcccaggacaccagagccgagcctgggggaggcggcgctgacaggaccttcctcagctgtggcatcttggg

SEQ ID NO: 301924 - DNA, 2782 bp, Homo sapiens
atgggaggtgcggcgacagtgtttgacgagagccgaaggaggctgtgggaggtgttggcggcggcggcgcgggcgcctgaggaggaggaggagaagcggatgagatcgtggggctcaccagcgtcccccatggcttctgagtagcgtgggagtggagtcagcaccaagccaggctccccgcgcctgccttgccctcacctgctcctgctctctgccagaggcagcatggtccgcagggcaccatggggcccgacagagtgacagcacgagaactgtgcgagaacgacgacctggccaccagcctcgtcctggacccctacctcggtttccgcacccataagatgaacgtcagccctgtgccccccctgcggcgacagcagcacctgcgctcagcgctggaaactttcctgaggcagcgggacctggaggctgcgtaccgggccctgacgctgggaggctggacggcccgctacttccagagccggggcccgcggcaggaggctgccctcaagacccacgtctatcgctacctccgtgccttcctgccggaaagtggctttaccatcctgccctgcacgcgctactccatggagaccaacggggccaagatcgtgtccactcgtgcttggaaaaagaatgagaagctggagctgctggtgggctgcattgcagagctgcgggaggcagatgaggggctgctgagggccggtgagaatgacttcagcatcatgtactcaacccgcaagcggagtgctcagctgtggctgggcccagccgccttcatcaaccatgactgcaaacccaactgcaagtttgtgcctgcagatgggaacgcagcctgcgtgaaggtgctccgggacattgagcctggggacgaggtgacatgcttctacggcgagggcttcttcggcgagaagaatgagcactgtgaatgccacacctgtgagaggaaaggtgaaggagctttccgaaccaggcctagggagcccgcgttgccaccacggcccctggacaagtaccagctgcgtgagaccaagcggcggctgcagcaaggcctggacagtggcagccgacagggcctgctgggccctcgggcctgcgtgcacccatccccgctgcgccgggacccattctgcgccgcctgccagcccctgcgcctgccagcctgcagcgcccgcccagacacctcacccctctggctccagtggctgcctcagccccagccccgagtgcggccccggaagcgccgacgcccccggccccggagggccccagtgctctccacccaccacgctgcccgcgtctccctgcaccgatggggaggctgtggcccccactgccgcctgcgaggagaggccctggtggccctgggccagcccccccacgcccgctgggcccctcagcaggactggcactgggcccggcgctatgggctgccttacgtggtgcgtgtggaccttcgtcgcctggccccagccccaccagctaccccagcccctgctgggaccccaggccccatcctgatcccgaagcaggccctcgccttcgcccccttctccccacccaagcgcctacggctggtggtcagccacggctccatcgacctggatgtcggcggtgaagagctgtgacaggccggacggggaggcccagcagggagagagggtctctctcctagctgctacccaggacctccagaaggagcccttggacctctgggagggagctgacccttgactccagcatagctctgaccctggaatggggttggtttggacacccccagggatctgagccctgaccctttgtgactgctgacccctgagccacccccactcccacagggagccccggccatttgctgccctccccacccctgccccagcctcaggactgcaggagccatccgcccccctcagccccttcctccccagggagcaaagccataaggggcaggggccaccccacggcatctccccagaagtacaggcctcaggaggaggtggaactgatgtagggggtggcactccccagagactgccctcacgaggggactgggttcgctctcagctctgcagctgtctgcggtggggggaaggttggggggtgtctggaggcatgttcccctcaccaccccccgtgggtctcagggaggccgggtgtgacctcatctttctcatggtgctatcctggtgctattggggtggggagctccctcccctcccccacaccagaaaggggtatgttgggggcttggaagcacttgaactttttattttattaaaaccttgttataagcagcacccttggcggttttttgttttggcttatgttttgaagggatgtgaggagggtgagaccctcagctgtgctgatgagagggggaggaggcaacacaggccttcagccctgagagctgtcgggagagggatttgggagcgtgatggactaggggactgaggctggagccccatccccactcaggctgtgcttgtaaaaatgccttgagacccatactctcctaggagtgggtcctcccattttccaggcgaggtcaacatcgtttagcaagcagagtgacttgccaaggccacgtggggacttgagggcccttctcccttctcgcgcttctcaatgagatgcccctcccacatctcactccaaacggagagagactgctgggggcctggctgagtgagggtgtgggggctgcccaggacaccagagccgagcctgggggaggcggcgctgacaggaccttcctcagctgtggcatcttggg

SEQ ID NO: 301925 - DNA, 2738 bp, Homo sapiens
atgggaggtgcggcgacagtgtttgacgagagccgaaggaggctgtgggaggtgttggcggcggcggcgcgggcgcctgaggaggaggaggagaagcggatgagatcgtggggctcaccagcgtcccccatggcttctgagtagcgtgggagtggagtcagcaccaagccaggctccccgcgcctgccttgccctcacctgctcctgctctctgccagaggcagcatggtccgcagggcaccatggggcccgacagagtgacagcacgagaactgtgcgagaacgacgacctggccaccagcctcgtcctggacccctacctcggtttccgcacccataagatgaacgtcagccctgtgccccccctgcggcgacagcagcacctgcgctcagcgctggaaactttcctgaggcagcgggacctggaggctgcgtaccgggccctgacgctgggaggctggacggcccgctacttccagagccggggcccgcggcaggaggctgccctcaagacccacgtctatcgctacctccgtgccttcctgccggaaagtggctttaccatcctgccctgcacgcgctactccatggagaccaacggggccaagatcgtgtccactcgtgcttgagctgcgggaggcagatgaggggctgctgagggccggtgagaatgacttcagcatcatgtactcaacccgcaagcggagtgctcagctgtggctgggcccagccgccttcatcaaccatgactgcaaacccaactgcaagtttgtgcctgcagatgggaacgcagcctgcgtgaaggtgctccgggacattgagcctggggacgaggtgacatgcttctacggcgagggcttcttcggcgagaagaatgagcactgtgaatgccacacctgtgagaggaaaggtgaaggagctttccgaaccaggcctagggagcccgcgttgccaccacggcccctggacaagtaccagctgcgtgagaccaagcggcggctgcagcaaggcctggacagtggcagccgacagggcctgctgggccctcgggcctgcgtgcacccatccccgctgcgccgggacccattctgcgccgcctgccagcccctgcgcctgccagcctgcagcgcccgcccagacacctcacccctctggctccagtggctgcctcagccccagccccgagtgcggccccggaagcgccgacgcccccggccccggagggccccagtgctctccacccaccacgctgcccgcgtctccctgcaccgatggggaggctgtggcccccactgccgcctgcgaggagaggccctggtggccctgggccagcccccccacgcccgctgggcccctcagcaggactggcactgggcccggcgctatgggctgccttacgtggtgcgtgtggaccttcgtcgcctggccccagccccaccagctaccccagcccctgctgggaccccaggccccatcctgatcccgaagcaggccctcgccttcgcccccttctccccacccaagcgcctacggctggtggtcagccacggctccatcgacctggatgtcggcggtgaagagctgtgacaggccggacggggaggcccagcagggagagagggtctctctcctagctgctacccaggacctccagaaggagcccttggacctctgggagggagctgacccttgactccagcatagctctgaccctggaatggggttggtttggacacccccagggatctgagccctgaccctttgtgactgctgacccctgagccacccccactcccacagggagccccggccatttgctgccctccccacccctgccccagcctcaggactgcaggagccatccgcccccctcagccccttcctccccagggagcaaagccataaggggcaggggccaccccacggcatctccccagaagtacaggcctcaggaggaggtggaactgatgtagggggtggcactccccagagactgccctcacgaggggactgggttcgctctcagctctgcagctgtctgcggtggggggaaggttggggggtgtctggaggcatgttcccctcaccaccccccgtgggtctcagggaggccgggtgtgacctcatctttctcatggtgctatcctggtgctattggggtggggagctccctcccctcccccacaccagaaaggggtatgttgggggcttggaagcacttgaactttttattttattaaaaccttgttataagcagcacccttggcggttttttgttttggcttatgttttgaagggatgtgaggagggtgagaccctcagctgtgctgatgagagggggaggaggcaacacaggccttcagccctgagagctgtcgggagagggatttgggagcgtgatggactaggggactgaggctggagccccatccccactcaggctgtgcttgtaaaaatgccttgagacccatactctcctaggagtgggtcctcccattttccaggcgaggtcaacatcgtttagcaagcagagtgacttgccaaggccacgtggggacttgagggcccttctcccttctcgcgcttctcaatgagatgcccctcccacatctcactccaaacggagagagactgctgggggcctggctgagtgagggtgtgggggctgcccaggacaccagagccgagcctgggggaggcggcgctgacaggaccttcctcagctgtggcatcttggg

SEQ ID NO: 301926 - DNA, 2762 bp, Homo sapiens
atgggaggtgcggcgacagtgtttgacgagagccgaaggaggctgtgggaggtgttggcggcggcggcgcgggcgcctgaggaggaggaggagaagcggatgagatcgtggggctcaccagcgtcccccatggcttctgagtagcgtgggagtggagtcagcaccaagccaggctccccgcgcctgccttgccctcacctgctcctgctctctgccagaggcagcatggtccgcagggcaccatggggcccgacagagtgacagcacgagaactgtgcgagaacgacgacctggccaccagcctcgtcctggacccctacctcggtttccgcacccataagatgaacgtcaggtctatcgctacctccgtgccttcctgccggaaagtggctttaccatcctgccctgcacgcgctactccatggagaccaacggggccaagatcgtgtccactcgtgcttgctgtgcctctggtaaatgaggaactgacgtaagcttggacgctgctgtgtgggcttgcatttgcatgagactgcgggagggcagactgaggggcttgcttgacgcggcgcgggtgagcgaactcgacgttcaggcattctagtcgctatcgtcgaagcgctcggctacgccggacgatcgctcatgccttggtggccttgtggcctcacgcctgccttctcgactctagagcgcgactgtagcttgcagagagccccagagcttcgcgagacccgttgtgtggccgtgctcccatgcgcgaacgtcatgcctagcgctgtgaatgggtgactccggtggacatttgcaggtcctggtggcactgaggctgcaccatgcctttctaccgcgcgacggtgcttcttcggcgatgaaggaattgagcgactgtgaatgcgcacaacctgtgatgacggacaccgtgactggaaaggtgaaggagctttccgaaccaggcctagggagcccgcgttgccaccacggcccctggacaagtaccagctgcgtgagaccaagcggcggctgcagcaaggcctggacagtggcagccgacagggcctgctgggccctcgggcctgcgtgcacccatccccgctgcgccgggacccattctgcgccgcctgccagcccctgcgcctgccagcctgcagcgcccgcccagacacctcacccctctggctccagtggctgcctcagccccagccccgagtgcggccccggaagcgccgacgcccccggccccggagggccccagtgctctccacccaccacgctgcccgcgtctccctgcaccgatggggaggctgtggcccccactgccgcctgcgaggagaggccctggtggccctgggccagcccccccacgcccgctgggcccctcagcaggactggcactgggcccggcgctatgggctgccttacgtggtgcgtgtggaccttcgtcgcctggccccagccccaccagctaccccagcccctgctgggaccccaggccccatcctgatcccgaagcaggccctcgccttcgcccccttctccccacccaagcgcctacggctggtggtcagccacggctccatcgacctggatgtcggcggtgaagagctgtgacaggccggacggggaggcccagcagggagagagggtctctctcctagctgctacccaggacctccagaaggagcccttggacctctgggagggagctgacccttgactccagcatagctctgaccctggaatggggttggtttggacacccccagggatctgagccctgaccctttgtgactgctgacccctgagccacccccactcccacagggagccccggccatttgctgccctccccacccctgccccagcctcaggactgcaggagccatccgcccccctcagccccttcctccccagggagcaaagccataaggggcaggggccaccccacggcatctccccagaagtacaggcctcaggaggaggtggaactgatgtagggggtggcactccccagagactgccctcacgaggggactgggttcgctctcagctctgcagctgtctgcggtggggggaaggttggggggtgtctggaggcatgttcccctcaccaccccccgtgggtctcagggaggccgggtgtgacctcatctttctcatggtgctatcctggtgctattggggtggggagctccctcccctcccccacaccagaaaggggtatgttgggggcttggaagcacttgaactttttattttattaaaaccttgttataagcagcacccttggcggttttttgttttggcttatgttttgaagggatgtgaggagggtgagaccctcagctgtgctgatgagagggggaggaggcaacacaggccttcagccctgagagctgtcgggagagggatttgggagcgtgatggactaggggactgaggctggagccccatccccactcaggctgtgcttgtaaaaatgccttgagacccatactctcctaggagtgggtcctcccattttccaggcgaggtcaacatcgtttagcaagcagagtgacttgccaaggccacgtggggacttgagggcccttctcccttctcgcgcttctcaatgagatgcccctcccacatctcactccaaacggagagagactgctgggggcctggctgagtgagggtgtgggggctgcccaggacaccagagccgagcctgggggaggcggcgctgacaggaccttcctcagctgtggcatcttggg

SEQ ID NO: 301927 - DNA, 2112 bp, Homo sapiens
ctcggaatgccacttttaggggctcagctgttgccccattccaggagaggacgctccgggccagggtgcccggccaggtgtggggagtgggtgagccctcccctgtgccctgggccaggcgctgagtgggcttggccctcagtttgtgcctgcagatgggaacgcagcctgcgtgaaggtgctccgggacattgagcctggggacgaggtgacatgcttctacggcgagggcttcttcggcgagaagaatgagcactgtgaatgccacacctgtgagaggaaaggtgaaggagctttccgaaccaggcctagggagcccgcgttgccaccacggcccctggacaagtaccagctgcgtgagaccaagcggcggctgcagcaaggcctggacagtggcagccgacagggcctgctgggccctcgggcctgcgtgcacccatccccgctgcgccgggacccattctgcgccgcctgccagcccctgcgcctgccagcctgcagcgcccgcccagacacctcacccctctggctccagtggctgcctcagccccagccccgagtgcggccccggaagcgccgacgcccccggccccggagggccccagtgctctccacccaccacgctgcccgcgtctccctgcaccgatggggaggctgtggcccccactgccgcctgcgaggagaggccctggtggccctgggccagcccccccacgcccgctgggcccctcagcaggactggcactgggcccggcgctatgggctgccttacgtggtgcgtgtggaccttcgtcgcctggccccagccccaccagctaccccagcccctgctgggaccccaggccccatcctgatcccgaagcaggccctcgccttcgcccccttctccccacccaagcgcctacggctggtggtcagccacggctccatcgacctggatgtcggcggtgaagagctgtgacaggccggacggggaggcccagcagggagagagggtctctctcctagctgctacccaggacctccagaaggagcccttggacctctgggagggagctgacccttgactccagcatagctctgaccctggaatggggttggtttggacacccccagggatctgagccctgaccctttgtgactgctgacccctgagccacccccactcccacagggagccccggccatttgctgccctccccacccctgccccagcctcaggactgcaggagccatccgcccccctcagccccttcctccccagggagcaaagccataaggggcaggggccaccccacggcatctccccagaagtacaggcctcaggaggaggtggaactgatgtagggggtggcactccccagagactgccctcacgaggggactgggttcgctctcagctctgcagctgtctgcggtggggggaaggttggggggtgtctggaggcatgttcccctcaccaccccccgtgggtctcagggaggccgggtgtgacctcatctttctcatggtgctatcctggtgctattggggtggggagctccctcccctcccccacaccagaaaggggtatgttgggggcttggaagcacttgaactttttattttattaaaaccttgttataagcagcacccttggcggttttttgttttggcttatgttttgaagggatgtgaggagggtgagaccctcagctgtgctgatgagagggggaggaggcaacacaggccttcagccctgagagctgtcgggagagggatttgggagcgtgatggactaggggactgaggctggagccccatccccactcaggctgtgcttgtaaaaatgccttgagacccatactctcctaggagtgggtcctcccattttccaggcgaggtcaacatcgtttagcaagcagagtgacttgccaaggccacgtggggacttgagggcccttctcccttctcgcgcttctcaatgagatgcccctcccacatctcactccaaacggagagagactgctgggggcctggctgagtgagggtgtgggggctgcccaggacaccagagccgagcctgggggaggcggcgctgacaggaccttcctcagctgtggcatcttggg

SEQ ID NO: 301928 - DNA, 1183 bp, Homo sapiens
atgggaggtgcggcgacagtgtttgacgagagccgaaggaggctgtgggaggtgttggcggcggcggcgcgggcgcctgaggaggaggaggagaagcggatgagatcgtggggctcaccagcgtcccccatggcttctgagtagcgtgggagtggagtcagcaccaagccaggctccccgcgcctgccttgccctcacctgctcctgctctctgccagaggcagcatggtccgcagggcaccatggggcccgacagagtgacagcacgagaactgtgcgagaacgacgacctggccaccagcctcgtcctggacccctacctcggtttccgcacccataagatgaacgtcagccctgtgccccccctgcggcgacagcagcacctgcgctcagcgctggaaactttcctgaggcagcgggacctggaggctgcgtaccgggccctgacgctgggaggctggacggcccgctacttccagagccggggcccgcggcaggaggctgccctcaagacccacgtctatcgctacctccgtgccttcctgccggaaagtggctttaccatcctgccctgcacgcgctactccatggagaccaacggggccaagatcgtgtccactcgtgcttggaaaaagaatgagaagctggagctgctggtgggctgcattgcagagctgcgggaggcagatgaggggctgctgagggccggtgagaatgacttcagcatcatgtactcaacccgcaagcggagtgctcagctgtggctgggcccagccgccttcatcaaccatgactgcaaacccaactgcaaggtaaggccttgggactcgggaggagagggcacgcaggaagaaagggtgcctgtggcctggggaaagggtttttggtcagtaaagagccaaacaccggccgggcgcggtggctcatgcctgtaatcccagcactttgggaggccgaggtgggcagatcacgaggtcaggagatggagaccacggtgaaaccccatctctactaaaaacacaaaaaattagtcgggcgtggtggcgggcgcctgtagtctcagctacttgggaggctgaggcaggagaatggtgtgaacccgggaggcggagcttgcggtgagccgagatcgcgccactgcactccagcctgggccacagagcgagactctgtctcaaaaaaa

SEQ ID NO: 301929 - DNA, 1484 bp, Homo sapiens
tgggattacaggcgtgagccacctcacccggcctattgatccatattctgtaatcaaaatatcataagcctccataatgtagtggggcatacaaaaggctttcatccattcaggtgaaaggtgaagtttgggtgtggtggtgcatgcctgtaatcccagctacttgggaggctgaggcaggagaattgtttgaacctgggaggtggaggttgcagtgagcccagatcacaccactgcactccagcctggacgacagagcgaaattctgtgtaaaaaaaaaaaaaaaaaaaaggtgaggtttcagatgtgtatgttaatctactcaatctaattagtttattgaattgctacaatgtattcagtattgtgctttataatatggaggatgatgtctctgtgcttttgctcattcttatccttgacttcaaattgtttcctattattctagcctcatctgttaaaatcctaccctcctttccctcaagagccatctaaagatgacacctttgtcacaaagcctttcatgatctcacagccacgaatttagaacttcctcctatagcattttctatcttttttatggcatttattttattctatcttgttatgattacataatctgtttaatccccaattatatattgtaaataccttgaaggaaaggagtctttattatctttggtgcctggtgtttagttttaatattttattaaatacatccaaggaaagtttttggtttctgcctttacttcaagaagaaagttgtagaacagataatagttgttccatttccatgggttactgagtaaagactcaccagttcgccataacagacataagagtgacaaaaaaataaaccttcattgtgtaaaaaaaaaaaaggccaggcgcagtggctcatgcctgtaatcccagcactttgggaggctgagccaggcagatcacttgaggtcaggagttcgagaccagcctggcctacatggtgaaacctcatctctactaaaaatacaaaaatcagcccagtatggtggtgcacaccagtaaacccaacaactggggaggctgaagcaggagaatcgcttgaacctgggaggtggcagttgcagtgaacccagatcacaccactgcactccaacctgggcgacagagcaagactctgtctcaaaaaaagaaaaaaatgaaagttgtgtttagggggacaaatacagtatagtgtttaattaaggacctagatatatggtttagatggtgctgtccaatatggaagccaccagccactttgtggctttttaaatttttaaatttagttaaaactaaataaagtaagcctggctaacatggcgaaaccccatctctattttaaaaaatacaaaaattaaatcccagcactttgggaggccaaggcaggcagatcacaaggtcaggagattgagaccatcctggctaacacggtgaaaccccgtctctactaaaaatacaaaaaa

SEQ ID NO: 301930 - DNA, 1285 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggtgaggtttcagatgtgtatgttaatctactcaatctaattagtttattgaattgctacaatgtattcagtattgtgctttataatatggaggatgatgtctctgtgcttttgctcattcttatccttgacttcaaattgtttcctattattctagcctcatctgttaaaatcctaccctcctttccctcaagagccatctaaagatgacacctttgtcacaaagcctttcatgatctcacagccacgaatttagaacttcctcctatagcattttctatcttttttatggcatttattttattctatcttgttatgattacataatctgtttaatccccaattatatattgtaaataccttgaaggaaaggagtctttattatctttggtgcctggtgtttagttttaatattttattaaatacatccaaggaaagtttttggtttctgcctttacttcaagaagaaagttgtagaacagataatagttgttccatttccatgggttactgagtaaagactcaccagttcgccataacagacataagagtgacaaaaaaataaaccttcattgtgtaaaaaaaaaaaaggccaggcgcagtggctcatgcctgtaatcccagcactttgggaggctgagccaggcagatcacttgaggtcaggagttcgagaccagcctggcctacatggtgaaacctcatctctactaaaaatacaaaaatcagcccagtatggtggtgcacaccagtaaacccaacaactggggaggctgaagcaggagaatcgcttgaacctgggaggtggcagttgcagtgaacccagatcacaccactgcactccaacctgggcgacagagcaagactctgtctcaaaaaaagaaaaaaatgaaagttgtgtttagggggacaaatacagtatagtgtttaattaaggacctagatatatggtttagatggtgctgtccaatatggaagccaccagccactttgtggctttttaaatttttaaatttagttaaaactaaataaagtaagcctggctaacatggcgaaaccccatctctattttaaaaaatacaaaaattaaatcccagcactttgggaggccaaggcaggcagatcacaaggtcaggagattgagaccatcctggctaacacggtgaaaccccgtctctactaaaaatacaaaaaa

SEQ ID NO: 301931 - DNA, 781 bp, Homo sapiens
aaatggagttaggctcgcgccggcgcagtgtcggctgccggtgccgcggcctttgtctcgcagtcaggagggagcaagtgacgtttgaggacgtggtagtggacttcagccaggaggagtgggggcagctgaagcctgcccagaggaccctgtaccgtgatgtaatgctggacaccttcaggcttctggtctctgtggctcccctttgccttccgccatgattggaagcttcctgaggcctccccatagtgcagatgccagcactatgcttcctgtacagcctgcagaaccgtgagccaaataaatctcttttctttgtaaattacccatcctcaggtattcctttatagccgtgtaaacagactaacacagccagggccgttggaagttttgtggaagcactgggtaggactgacgtgtggtagtcactgtccctcctgagtctcctcttatactgtatgtgagagggagattctttcaggcagcaagtattttccaagcaccaactatagctcaggcacaattccagactctggcaactaaactgatgaaactcgtggtctcaggagcttatattttggtggggaaatggaaaatagagaaattaggatgttatgggcacattacacagtaagtgttatgtagaaacaaaatggtccaagaagggaaaccccaggctgggcgcagtggctcaagcctgtaatcccagcactttgtgaggccaaggcaggcagattgcctgaggtcgagagttcaagaccagcctggccaacatggagaa

SEQ ID NO: 301932 - DNA, 3036 bp, Homo sapiens
aaatggagttaggctcgcgccggcgcagtgtcggctgccggtgccgcggcctttgtctcgcagtcaggaggagcagggccagccgttcctgccagaagccaggcatgacccctggggtgcgcgtctccacagacccggagcaagtgacgtttgaggacgtggtagtggacttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggccttcagccacagctcatccttgaccaaacaccagcgaatccacacaggggagaagccctacgagtgccatgagtgtggaaaagccttcacccagatcacaccactgattcagcaccagaggacccacacaggagaaaagccctatgagtgtggtgagtgtgggaaagccttcagtcagagcacactcctgaccgagcatcggaggattcacacaggagagaagccctatggatgcaacgagtgtgggaaaaccttcagccacagctcctcactcagccagcatgagcggacacacacaggagagaagccctatgagtgcagtcagtgtgggaaggccttccggcagagcacacacctcacccaacaccagcgaatccacacaggggagaagccctatgaatgcaatgactgcggcaaggcattcagtcacagctcgtccctcaccaaacatcagcgaatccacactggggagaagccctacgaatgcaaccagtgtggcagagccttcagccagcttgctcccctcattcagcatcagaggatccacacaggagagaaaccctatgaatgtaaccagtgtggcagagccttcagccagagctcccttctcatcgaacaccagaggattcacaccaaggaaaagccgtatgggtgcaatgagtgtgggaaatccttcagccacagctcctcgctcagccagcacgaaaggacgcacactggggaaaagccctatgagtgtcacgattgcggaaagtcctttaggcagagcacccacctcactcagcaccggaggatccacacaggagagaagccatatgcatgcagggactgtggaaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccatgggaccaccaagctctaggtcatccatctctgcatccaaatagtagggaaacgtggagataatcaacactcaggaccttcagccttgaacgcccattagtgctatgttatagaacctacaaaaaagaaatggaacaaatgtagtggatccagggaacgcttttgtccaaggattcaccgtattccaaaccagagatgttcaaattggtgagaaacccaacaaatgcctttcatatatacgagaaccaaatgaagtcagaatttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccatagagtctcactgattctgagatggcttttgctgctctgttctccctctacatttctctgcagaactcgcgttagaaacacagatatttgttttacaaaaagggagatttttcctttgttaaaccatcgtcttataagcaatagcaaattcatgttagaaaaactttag

SEQ ID NO: 301933 - DNA, 1390 bp, Homo sapiens
gcttataatcgaggtttctcttttacacagggttatctgtaaaacatttaggtctggcttgctcccctcattcagcatcagaggatccacacaggagagaaaccctatgaatgtaaccagtgtggcagagccttcagccagagctcccttctcatcgaacaccagaggattcacaccaaggaaaagccgtatgggtgcaatgagtgtgggaaatccttcagccacagctcctcgctcagccagcacgaaaggacgcacactggggaaaagccctatgagtgtcacgattgcggaaagtcctttaggcagagcacccacctcactcagcaccggaggatccacacaggagagaagccatatgcatgcagggactgtggaaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccatgggaccaccaagctctaggtcatccatctctgcatccaaatagtagggaaacgtggagataatcaacactcaggaccttcagccttgaacgcccattagtgctatgttatagaacctacaaaaaagaaatggaacaaatgtagtggatccagggaacgcttttgtccaaggattcaccgtattccaaaccagagatgttcaaattggtgagaaacccaacaaatgcctttcatatatacgagaaccaaatgaagtcagaatttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccatagagtctcactgattctgagatggcttttgctgctctgttctccctctacatttctctgcagaactcgcgttagaaacacagatatttgttttacaaaaagggagatttttcctttgttaaaccatcgtcttataagcaatagcaaattcatgttagaaaaactttag

SEQ ID NO: 301934 - DNA, 614 bp, Homo sapiens
aaatggagttaggctcgcgccggcgcagtgtcggctgccggtgccgcggcctttgtctcgcagtcaggaggagcagggccagccgttcctgccagaagccaggcatgacccctggggtgcgcgtctccacagacccggagcaagtgacgtttgaggacgtggtagtggacttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccaggtgagatgggagcccttcggggcagagagaagcctgtccatgcttgcttcctggtttctccctctgcatctgctctctaattcttcagagcaaatttactactcagtcttagtgaagatttaccaagcacccattttgctgtgagtgacgacaccacgtcctcatctccactgaatttatattcttggtgagggagtgggggaaacaaacaataaatcggtaaaataataataataaaacaagttggatgatta

SEQ ID NO: 301935 - DNA, 5617 bp, Homo sapiens
  misc_feature (587)..(587): n is a, c, g, or t
cggctgtacgcccggaattatgggatagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcggggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgangaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcgtcccgggcctcgctgaaggccaagctcctccgcaggtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcgaaa

SEQ ID NO: 301936 - DNA, 3980 bp, Homo sapiens
ggcagcaggccgaagctcttcttcttccgctcgctcttggccttggttggccgcagcttgcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcgaaa

SEQ ID NO: 301937 - DNA, 229 bp, Homo sapiens
acttataggttacagtccggaattacccaggtcaacaactacttttaaattagaggccgtgtcgacccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaag

SEQ ID NO: 301938 - DNA, 5719 bp, Homo sapiens
  misc_feature (587)..(587): n is a, c, g, or t
cggctgtacgcccggaattatgggatagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcggggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgangaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcgtcccgggcctcgctgaaggccaagctcctccgcagacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcgaaa

SEQ ID NO: 301939 - DNA, 4651 bp, Homo sapiens
caacagtggtggccttggtgtgggggcagcctcccccttccctttgagcagtgaccttccctctgcagccatccagtctctgctgccttgatcttgtcccagctggcgatggatggtgcccactcgagacccagccactgagcaccaaggttgggggcggctcagccttggccccccaccacgctctgcagaaacaggccttggaactggtttctgaaaagtcacttctggtccagaaccttctcctctaaatgggcgccttctttttcaacacgtccatctgtctacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcgaaa

SEQ ID NO: 301940 - DNA, 1960 bp, Homo sapiens
tggcacgaggtacttgaccgagctcatcgacaggtacaagagatggaaggcgggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcgaaa

SEQ ID NO: 301941 - DNA, 5343 bp, Homo sapiens
  misc_feature (587)..(587): n is a, c, g, or t
cggctgtacgcccggaattatgggatagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcggggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgangaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcgtcccgggcctcgctgaaggccaagctcctccgcagacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcgaaa

SEQ ID NO: 301942 - DNA, 3540 bp, Homo sapiens
  misc_feature (587)..(587): n is a, c, g, or t
cggctgtacgcccggaattatgggatagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcggggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgangaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcgtcccgggcctcgctgaaggccaagctcctccgcagacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacgggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcgaaa

SEQ ID NO: 301943 - DNA, 2070 bp, Homo sapiens
tgggtaaatggatcagagcctcccaggtcagtcccaggtctgcagcttgtccagatggcaacagtgacccttcacttctactctagcgttcaaataggaacgatgtcaggatccgtatgaagtgtgaaatactagaaccctagccgctagctcgtggcttggggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcgaaa

SEQ ID NO: 301944 - DNA, 6098 bp, Homo sapiens
  misc_feature (587)..(587): n is a, c, g, or t
cggctgtacgcccggaattatgggatagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcggggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgangaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcgtcccgggcctcgctgaaggccaagctcctccgcagacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcgaaaaaaaaaaaaaaaaaaacacctcgagaacaagtctctctctctctctctccctttgaccagcccctgggcggtgggcaaaaacaagcgccttaagaaagggcggcaaaaggggcacccacgaagaacgggggttgacccattttctaagaacagatgggtatgcttgtgaaagcccctgctatgttccaatcatagcgcaactttgggaaagacgcctgttcccccgggtccccctgggacccacattggcttctcgagggtccccagggccgggtgctcgaagatgaatctggcgattggcgcatgatgaagtgcctttgaaaatcacgccgttctgggaatgttcggaaaagccgaaatcccgaggggttaccggaag

SEQ ID NO: 301945 - DNA, 5796 bp, Homo sapiens
  misc_feature (587)..(587): n is a, c, g, or t
cggctgtacgcccggaattatgggatagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcggggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgangaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcgtcccgggcctcgctgaaggccaagctcctccgcagacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcgaaaaaaaaaaagaaaacaaaggtttgccctatcagtgagtcggattaattgtccgcgcggccggacatttagtagtagta

SEQ ID NO: 301946 - DNA, 5722 bp, Homo sapiens
  misc_feature (587)..(587): n is a, c, g, or t
  misc_feature (5478)..(5478): n is a, c, g, or t
  misc_feature (5490)..(5490): n is a, c, g, or t
  misc_feature (5577)..(5577): n is a, c, g, or t
cggctgtacgcccggaattatgggatagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcggggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgangaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcgtcccgggcctcgctgaaggccaagctcctccgcagacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctctccaggaaaacaaaccgacgtacaaaaaaacatgtaaacactgttcctagcttgtgggttgtacccagacagcacgctggcaggtctggtctttgagccaacagtggtggccttggtgtgggggcagcctcccccttccctttgagcagtgaccttccctctgcagccatccagtctctgctgccttgatcttgtcccagctggcgatggatggtgcccactcgagacccagccactgagcaccaaggttgggggcggctcagccttggccccccaccacgctctgcagaaacaggccttggaactggtttntgaaaagtcacntctggtccagaaccttctcctctaaatgggcgccttctttttcaacacgtccatctgtctgtgagtctgggactcctgggcggtctnggcatctgtctcggcctcctctgtcttccccacctcgcggcctctctcggagaatgttccctctgccccgagtgttttcacgcccctcctgacagcctgccaaggtgaatctgtctcttctgtcttttctgtccttctgatttcc

SEQ ID NO: 301947 - DNA, 4142 bp, Homo sapiens
  misc_feature (587)..(587): n is a, c, g, or t
cggctgtacgcccggaattatgggatagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcggggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgangaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcgtcccgggcctcgctgaaggccaagctcctccgcagacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctggtgaggagcctggggcctggaggggcttggccgatcatggcctgggctgcagccctgcagggctgtctgctgcacaccctgtagcccacctgcgcacaaggcacttggggctgtccacgcctgctggaaaatgacactcagctggccctttaaatcagcttcctgcagagccttgggacctggcccagaaagaagatgaggaggccaggcctggtggctcatgcctgtaatcccagcactttgggaggccgaggcgggtcgatctcctgaggtcaggagttcgagaccagcctggccaacatatgaaaccccgtctctactgaaaatgcaaaacttagctctgcatggcgggacgtgcctgtgatcccagctactcgggagactaaggcgggagaattgcttgaacctgggcggcggaggttgcagtgagctgagattgcgccactgcactccagcctgggcgacagagtaagactctgtctcaaaaaaaaaaagatgaggagagcaaaatgcagatgttgctggggccgcgtccccactaagggctgtgcatgtggcagcgctgatggggaggacgcatttgtccctgtgcactccggcctctgcacacgtgtctcgtgggcccctggaggctgggcccgcagccagtagcacccagcagcgtcctgcctgcttttcctgcctggtttatcttcccagccgcggacacagtgcctggtgttgacattcaggcttgcgtggaggtggggctggaagcagacagatcagtctggcagggtgggtctgctggggagaccacaagggtgggactgatgccggccacaaagcccgggctcccatgcactggtgcgaggtgcccacgagcccggcgggcttggatgccatgcttggagcccacaggtgctgggccacctgggcagggctgtgcaggcagtcacagaggctcatctggaaggggagccctctttccttgttcgtggagtggagtgtgcagtgggtcacgccggcctggccgggcacggccaggcgattaggaagccggcagcccgcgggtgatgcttccgaggcaccagtgactcagtccacaaacgtgggcgtaaaaggcctcatgattcaggtggagtgatggtgcgatgcgtggtgcagtgataagtcctcctgcccgacgccttatggatcatctgacatttccagaacgcagcctcttcattaccggtgcttgtaacgatgaattaaaaatccttttacacg

SEQ ID NO: 301948 - DNA, 4015 bp, Homo sapiens
  misc_feature (587)..(587): n is a, c, g, or t
cggctgtacgcccggaattatgggatagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcggggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgangaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcgtcccgggcctcgctgaaggccaagctcctccgcagacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaag

SEQ ID NO: 301949 - DNA, 1820 bp, Homo sapiens
  misc_feature (587)..(587): n is a, c, g, or t
cggctgtacgcccggaattatgggatagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcggggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgangaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcaggggcagggagtcggcggcttagcttcctctggagcacggttccatcagccagaaaatgctctacctttgatggcgaagatggtctccccactctgtgaatacacaagctcctgcgtcgcacacctggtgaattgtagggcacacgaatctcactgaaactgtccagaaacatccttcccccagatcagctctcagcaaatcaggaacagtaatccagaataaaaactgggcagcctttctggaaggccgtctgccatgggttacacatgtgtctcctgtggcctagcggttctgtctctggaacacgtgcataccggttccatgtctagggatatctgtagccccgtttgttgtagtggaaagttctatgaccaggggatgggttgaaccagtggaatgttatgcagctgtgaaaatgggtttgctccatgaggtttgctctgtatctttgggcatggagagatgagcgcgacaactttaagggaaaaaataggctgtggactgggactcttgtgattcccgttttttgtggggatgtggttcttgaactgggaaagggagatttgcccaagtattggttgatattagtttgatgtcatggaatttgggataccttaaaaatatgcactaacttctcaatatggttctgtctttttttgtact

SEQ ID NO: 301950 - DNA, 1012 bp, Homo sapiens
cacgtttttctaccaaacatactttcaaaagtagaaaatcatggatttaaaaaacttttttgtagggcttgatatgtctaaatgtatcaagtttcaagtgtgctaactttatgaacacttgtctctgttcttaaatgcataacatgatcttaaatttttcagatctttagaaatgttaagcaatgcaaagatttctaccccatctccctccacatctttaaaagccaaaaaccacctaccaaaactccattactgtttgtgaatgaagaattttcatgacttgaaaaccttcctaatgtcccatctttaacacttttttagaaaggagggctcttgttgtgttctttaacctcttttcacatcattaacttcttcatggttgacatcagtactatcctcttaaaaattcaaatgtgaactaacagcatcatttattgaaggcatattatgttaaaattagtgattttcccaaggacaaaatgttaagtggaaaagtcagtactcagattcaggtgtgactcccaggcccaagcatagcctgaaatgaattaagaaggtcaccatattaattttcataaggtgaaagaaaacaagcattatatatttttccacatcagaaaatgttgaagacctaagagactccagtggctggctctgaaccctacagcaagacagtggcagagttggaatggattctggatgtctttgctaaccattaagaaagagttactgaataactttccattactcttaaaaagttactgttcccaagtgtattgagaattcggagatctgaagtaagacagaaatctttgttttcagttgtctttaagcttttgccagtaacatggtcccagtagaagaaaacataaaactgtaatcctaatcaaattttgcaacatcaaatactatttcaatagtttcaaatactattccaatattgttccagcaatattccaaataatactaagaaatattttaaatgaataaagactaacaatcttcaaaagtt

SEQ ID NO: 301951 - DNA, 2692 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301952 - DNA, 542 bp, Homo sapiens
atctccctgtgcttccggtagaggggcctgaagtgatatggtgggacagattaatacattctgagagtacaggttggcatctgcctgtggctagggagagagacccttagagctgtgaatcctgatgttcaggatctttgcaccacaagggttaaggaaatgttttgcagttgtctttttaaaaacattaagcacatttgtgaagccttcacaattatatctttagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301953 - DNA, 506 bp, Homo sapiens
acagtttggttatgggagtataggatgactcactgacaaatggaacctgtatattataggtccctcgatgaatatatgagaaggcacttgatgggcaaaaccattaggtcacttccttccacgtgatgattattggctctgtcagccccattatcacagagtattcaagaaatactttgtggtcactgccctcttaatatagggagcaaagcagagtttgggtgacttgtatatgcttcctatgactgaggcctcagttatataagacagaatggcttaaactaggctcactgatgcccaggttctgtttgtcttccaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301954 - DNA, 482 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaagtaagcgggactgtggaaagcttaaggcactggccagtccgcggggagggctaatggacgggggctccggagaaggggcagaccggtgggcgggagtacttgccttcccaagagcagctgtcgctgtgaaggcctggtcactggagcagtccttcttttgctgagagcctcgcgcagcagcggtaacggcggtcggctggcgcc

SEQ ID NO: 301955 - DNA, 357 bp, Homo sapiens
tgcacagcagtcccctaaacccaactcacgtttctgtatgtcttaggccagtatcccaaacctcttccacgtcgctgttctttccacccattctccctttgcatcttgagcagttatccaactaggatctgccaagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301956 - DNA, 1675 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301957 - DNA, 1597 bp, Homo sapiens
  misc_feature (25)..(25): n is a, c, g, or t
gttaggctaggtacgaggcggtgtnaatcggcacgaggtcagtccttgaaaacaagccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301958 - DNA, 2329 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaggttgaggctttgatggtttttttcttaattattggctgaatctgccttggagcactgctggttttatatattagccaaaggttttgttctggccttctgtactgatctgtgttcctgatcctaattcctatctgtctaacgtggaggtgatcaagtgtggctgtaggcctttgttttccaatggtgctatattctgttttcaaacacttcactgaacccagctgtcttgcaaactttcagtggtgctgtccctggatgggggctacaaaaacaagaattggtgaagatcttgctcttcagtgctgaaaatggatgatggactttggctgtgagccaggcctaggatggttcttgtcctatatccacctagtcttcacctggggctataattctgtcctggaaaaagaactctgaaaacctgggtcaggggaatgattcctaaggaaaacggtctgcatttgagctctggtttgaaagtagccaaggggactgatggtggacactccagatgtggttggaagcatatgtggggaggctggctggttgagttttgttattttctgtatagaaaggttgagatatatcaacacttggaattgttacccatctgcagaattgacttctcaaataaagatgctaaaaatcaaaaaaac

SEQ ID NO: 301959 - DNA, 2125 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaggttgaggctttgatggtttttttcttaattattggctgaatctgccttggagcactgctggttttatagatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcc

SEQ ID NO: 301960 - DNA, 1770 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaggttgaggctttgatggtttttttcttaattattggctgaatctgccttggagcactgctggttttatactgatgaattcggggatacactagag

SEQ ID NO: 301961 - DNA, 1746 bp, Homo sapiens
  misc_feature (1691)..(1691): n is a, c, g, or t
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaaaaaaaaaatcggctntttcgggggaaggtaaggctgcatttccggccttgaaggggatgggccggggaag

SEQ ID NO: 301962 - DNA, 1894 bp, Homo sapiens
  misc_feature (1677)..(1677): n is a, c, g, or t
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaanaacaaaaaacaacacaaggggggggcaaaaaaacccggggggcaagttaccgtcacccgcttttggacaaggggcccaaagggagcggaaaaaacagaagaggcggggctaaagcgcgcggaaagtgcccggtcctggcgaccccctcgggggcaatgcaccacccaataagcccggaaaatcagatgtgacacgctccgcatgtgtaacacaccgg

SEQ ID NO: 301963 - DNA, 1701 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaaaaatcacaccggcctcgtacctgcc

SEQ ID NO: 301964 - DNA, 1638 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtggggggggatataaggtaggtgggagtgggggaggag

SEQ ID NO: 301965 - DNA, 1627 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301966 - DNA, 1518 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggagactgaagagcctcctccaccaggagtgaaa

SEQ ID NO: 301967 - DNA, 1340 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtacgaacgccaacagaccgacccttccccaccaagttttcccactcacaac

SEQ ID NO: 301968 - DNA, 2765 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagcaaccattaatctgctttctgtcactgaagatgggttgcattttgtagaatattatctaaatagaatcatacatctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301969 - DNA, 2772 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagagatgaggtttcgtcacgttgcccaggctggggctcaagccatcttctcacctcagccacctgaagtgctgggattacagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301970 - DNA, 2297 bp, Homo sapiens
ctcaagtaaaacaatacctagtgtaacaagcttgggtttcttttgcagtaagttgctctgctagccgggatgctccctttccttttctctagggggcagataatttttaggccatctgctgaaacttggtaggctttttgagggtttaaagggaatgtatttttagtttccatttatgcctttatcattaaactcgaagacatgtttatgcttcatgttctttaaccatgtagaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301971 - DNA, 2581 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301972 - DNA, 1748 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagcaaccattaatctgctttctgtcactgaagatgggttgcattttgtagaatattatctaaatagaatcatacatctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301973 - DNA, 1105 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcagcaggaggaataagatcctgtgacgacctcac

SEQ ID NO: 301974 - DNA, 1564 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301975 - DNA, 1081 bp, Homo sapiens
  misc_feature (1027)..(1027): n is a, c, g, or t
  misc_feature (1034)..(1034): n is a, c, g, or t
  misc_feature (1049)..(1049): n is a, c, g, or t
  misc_feature (1054)..(1054): n is a, c, g, or t
  misc_feature (1056)..(1058): n is a, c, g, or t
  misc_feature (1067)..(1067): n is a, c, g, or t
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggggggcagtcgaatttganttggaanaggggtaagcggggnggggngnnnggaaaaaanggggggcaaaaaag

SEQ ID NO: 301976 - DNA, 2203 bp, Homo sapiens
ggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaggttgaggctttgatggtttttttcttaattattggctgaatctgccttggagcactgctggttttatatattagccaaaggttttgttctggccttctgtactgatctgtgttcctgatcctaattcctatctgtctaacgtggaggtgatcaagtgtggctgtaggcctttgttttccaatggtgctatattctgttttcaaacacttcactgaacccagctgtcttgcaaactttcagtggtgctgtccctggatgggggctacaaaaacaagaattggtgaagatcttgctcttcagtgctgaaaatggatgatggactttggctgtgagccaggcctaggatggttcttgtcctatatccacctagtcttcacctggggctataattctgtcctggaaaaagaactctgaaaacctgggtcaggggaatgattcctaaggaaaacggtctgcatttgagctctggtttgaaagtagccaaggggactgatggtggacactccagatgtggttggaagcatatgtggggaggctggctggttgagttttgttattttctgtatagaaaggttgagatatatcaacacttggaattgttacccatctgcagaattgacttctcaaataaagatgctaaaaatcaaaaaaac

SEQ ID NO: 301977 - DNA, 2161 bp, Homo sapiens
agtagagacggggtttcaccatgttcgccaggatggtctcaatctcctgacctcgtgatccgcccgcctcggcctcccaaagagctgggattacaggtgtgagtcaccgcgcctgaccctgttaaagtattttctaagcttctttgaaaacggaatctctttgtggttgctgctgataaaactcctttgacctgacgattgctctaagtcctaattgccatatttatattcccatagtaagagtgtttggagatagtgtttgagcttttttgctggtgttaaaaatgcataatgaaagatggcagagagaggcatattatatccaattcatgagttgtttgtgttaacagaaagcttattttaatcacttaacattgttgatttgtctaatcacagtagcgctattgattaggagcctgacctttagatggttgacttgtgagtgtattcaatatggtgaaatatggtgttgatatatggctgcagattttagaggtgtcattagcaaaggtataggagtaaaataggggttatagtattccttactcaaattctgtatgtgctagagctggctggagtctgtggcatgctcattggtgtaagtcggtaaggactatgctttttgctccacatctctgttgtgggaaagctagtctcttgagcattcttgatcagaatggactggaataatttaactttcgtactttcccaggctattagtattatctaatgagtggcttaaagataccagaaacactgactgaggtctccacctgcttctggctgaatgaatgggagcttctagccattgaataagaggcagtagccaatgtttcttattctgaatggtccaggttgacttttataagagaaacactcagccttttaattgctgaaggtctggcccatagactaagattgcacattcttagtctaggttacacttgaactagactgcacccactgacgatatattcagttcaggtgttaactcacttggattagcatctggcctgtcctatctgaatataggttgagacgtgtattggaatctctgactagtcagaatacgttcttagttatattctcaatactgaggaatttttacttgtagaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301978 - DNA, 1483 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301979 - DNA, 1373 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301980 - DNA, 2833 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaaggtaaccgggatatgcaagagctgcagtgggtggagtacattctggatttgactcactaattatgggtaaaagtcagccttccattcaggattttccgtctgcctttggattaggaaagggctaaatgaaaaggggggtagtttaacaaggtcgtgatagtcaagtaagttcaatcaaaagcagcaagtcttctttagctggcttataaactaacacttttactaactgcaaaataggccttctgtgtgatttctgagacttggctagctatcagtaacttgttgcagcatactagccaataaagtgggatggaaaaggtagatgaggggtggggtaggtagggaaatagtgggctaggctggcagagaatgctgaatggatgttcacttgcatgcctctggattttaaaattattgttcacatgactccttttctgtgcgttgggaagcagctacagagcagtagaatccactgaattggtacactgaagcaggcatgccatttaaatgaaggcagttaaccttgactgttgtatcaccagagttaaagaattctggtgcccctctttaagtcttcaggaagtgtttagaggcttattcacattagttaaaacaggccccccccaccttccccaaggcaacagaaaacataaccattagctctcttcctgttttccttcctcatttcatgcttgcttcggctgctaaactgaatttttgttacttagaatattataaagtgtggatgctttctataatgctattggtctaagtgtgattaaatttcattaaggtgtataagcctctaattattacataactggcacgtctgacttttgctatcatttgaggattctactgtatataagtttcatctaacattggcattaataaccacaggtatattccaactaattgttacttcttgtaattgccagactacttcaagagttctcgtaagttttagattttcagagacccatcttcaatactttgaactcattctggtaaacttccttctacctatgtgcaggtccctgtactccagccaacacaggctcagtaactggaaatgaattggctaaaatggtagcaccattgggtttcttaatggagctttaggagttctttatggaaaaaagcacagaactaaattcctcaaaaaacaaacaaacaaaaccacacacac

SEQ ID NO: 301981 - DNA, 2779 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaaggtaaccgggatatgcaagagctgcagtgggtggagtacattctggatttgactcactaattatgggtaaaagtcagccttccattcaggattttccgtctgcctttggattaggaaagggctaaatgaaaaggggggtagtttaacaaggtcgtgatagtcaagtaagttcaatcaaaagcagcaagtcttctttagctggcttataaactaacacttttactaactgcaaaataggccttctgtgtgatttctgagacttggctagctatcagtaacttgttgcagcatactagccaataaagtgggatggaaaaggtagatgaggggtggggtaggtagggaaatagtgggctaggctggcagagaatgctgaatggatgttcacttgcatgcctctggattttaaaattattgttcacatgactccttttctgtgcgttgggaagcagctacagagcagtagaatccactgaattggtacactgaagcaggcatgccatttaaatgaaggcagttaaccttgactgttgtatcaccagagttaaagaattctggtgcccctctttaagtcttcaggaagtgtttagaggcttattcacattagttaaaacaggccccccccaccttccccaaggcaacagcggctgctaaactgaatttttgttacttagaatattataaagtgtggatgctttctataatgctattggtctaagtgtgattaaatttcattaaggtgtataagcctctaattattacataactggcacgtctgacttttgctatcatttgaggattctactgtatataagtttcatctaacattggcattaataaccacaggtatattccaactaattgttacttcttgtaattgccagactacttcaagagttctcgtaagttttagattttcagagacccatcttcaatactttgaactcattctggtaaacttccttctacctatgtgcaggtccctgtactccagccaacacaggctcagtaactggaaatgaattggctaaaatggtagcaccattgggtttcttaatggagctttaggagttctttatggaaaaaagcacagaactaaattcctcaaaaaacaaacaaacaaaaccacacacac

SEQ ID NO: 301982 - DNA, 1824 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcggaagaggatgataaagaaaatgataagactgaagaaatgccaaatgattcagtccttgaaaacaagtctcttcaagaaatgaggaggagagattggacctagactcctggatatctggattagcaaggtcattttaaaggcaggacaaagagcccactttatctc

SEQ ID NO: 301983 - DNA, 1520 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301984 - DNA, 1023 bp, Homo sapiens
  misc_feature (25)..(25): n is a, c, g, or t
gttaggctaggtacgaggcggtgtnaatcggcacgaggtcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 301985 - DNA, 1629 bp, Homo sapiens
  misc_feature (25)..(25): n is a, c, g, or t
gttaggctaggtacgaggcggtgtnaatcggcacgaggtcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctggagctacagttgaaagcactgcatgttaagagggggcacagccctcctcccaagggaaagtgtttttgtatataatgtattttttcacttttggaggattctttttgtataacttcaataaagattgtaagcaaaggttgaggctttgatggtttttttcttaattattggctgaatctgccttggagcactgctggttttatatattagccaaaggttttgttctggccttctgtactgatctgtgttcctgatcctaattcctatctgtctaacgtggaggtgatcaagtgtggctgtaggcctttgttttccaatggtgctatattctgttttcaaacacttcactgaacccagctgtcttgcaaactttcagtggtgctgtccctggatgggggctacaaaaacaagaattggtgaagatcttgctcttcagtgctgaaaatggatgatggactttggctgtgagccaggcctaggatggttcttgtcctatatccacctagtcttcacctggggctataattctgtcctggaaaaagaactctgaaaacctgggtcaggggaatgattcctaaggaaaacggtctgcatttgagctctggtttgaaagtagccaaggggactgatggtggacactccagatgtggttggaagcatatgtggggaggctggctggttgagttttgttattttctgtatagaaaggttgagatatatcaacacttggaattgttacccatctgcagaattgacttctcaaataaagatgctaaaaatcaaaaaaac

SEQ ID NO: 301986 - DNA, 718 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgggtatgtggagttgcatgtgacattcaagagatgcgacgttgtatatttcttgtatacagtggtggaaacggggctctacctgtcctgga

SEQ ID NO: 301987 - DNA, 656 bp, Homo sapiens
acggagggtatgggtggtgagtcctggccctttaaacccgagggggaggatccggaagtggatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatggaaaccagcaccggtaccgagctcgatc

SEQ ID NO: 301988 - DNA, 1186 bp, Homo sapiens
ccgggagcccttaaccctccgggagcccttaaccctccgggagcccttaaccctccgggagcccttaaccctccgggagcccttaaccctccgggagcccttaaccctccgggagcccttaaccctccggagcccttacccctaaggaaatgttttgcagttgtctttttaaaaacattaagcacatttgtgaagccttcacaattatatctttagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaggttgaggctttgatggtttttttcttaattattggctgaatctgccttggagcactgctggttttatatattagccaaaggttttgttctggccttctgtactgatctgtgttcctgatcctaattcctatctgtctaacgtggaggtgatcaagtgtggctgtaggcctttgttttccaatggtgctatattctgttttcaaacacttcactgaacccagctgtcttgcaaactttcagtggtgctgtccctggatgggggctacaaaaacaagaattggtgaagatcttgctcttcagtgctgaaaatggatgatggactttggctgtgagccaggcctaggatggttcttgtcctatatccacctagtcttcacctggggctataattctgtcctggaaaaagaactctgaaaacctgggtcaggggaatgattcctaaggaaaacggtctgcatttgagctctggtttgaaagtagccaaggggactgatggtggacactccagatgtggttggaagcatatgtggggaggctggctggttgagttttgttattttctgtatagaaaggttgagatatatcaacacttggaattgttacccatctgcagaattgacttctcaaataaagatgctaaaaatcaaaaaaac

SEQ ID NO: 301989 - DNA, 1160 bp, Homo sapiens
acagtttggttatgggagtataggatgactcactgacaaatggaacctgtatattataggtccctcgatgaatatatgagaaggcacttgatgggcaaaaccattaggtcacttccttccacgtgatgattattggctctgtcagccccattatcacagagtattcaagaaatactttgtggtcactgccctcttaatatagggagcaaagcagagtttgggtgacttgtatatgcttcctatgactgaggcctcagttatataagacagaatggcttaaactaggctcactgatgcccaggttctgtttgtcttccaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaggttgaggctttgatggtttttttcttaattattggctgaatctgccttggagcactgctggttttatatattagccaaaggttttgttctggccttctgtactgatctgtgttcctgatcctaattcctatctgtctaacgtggaggtgatcaagtgtggctgtaggcctttgttttccaatggtgctatattctgttttcaaacacttcactgaacccagctgtcttgcaaactttcagtggtgctgtccctggatgggggctacaaaaacaagaattggtgaagatcttgctcttcagtgctgaaaatggatgatggactttggctgtgagccaggcctaggatggttcttgtcctatatccacctagtcttcacctggggctataattctgtcctggaaaaagaactctgaaaacctgggtcaggggaatgattcctaaggaaaacggtctgcatttgagctctggtttgaaagtagccaaggggactgatggtggacactccagatgtggttggaagcatatgtggggaggctggctggttgagttttgttattttctgtatagaaaggttgagatatatcaacacttggaattgttacccatctgcagaattgacttctcaaataaagatgctaaaaatcaaaaaaac

SEQ ID NO: 301990 - DNA, 103 bp, Homo sapiens
tccaaaagttttaaaaaatgaaactattgctcaaatgtagcaggtattcaaaaaatactgatttaaacagtacttgacactagaaaaaatcttttttttgcag

SEQ ID NO: 301991 - DNA, 458 bp, Homo sapiens
gtttgggaaatagtatggtcctattacaaatggaatgcatataggtcttgttcttttgacaagagacatgcttttcaggcggctggatggaggaatatgcttatttccttcagtgctcttgcagtcttaatttatattactaaagttttgatcattgcttccttgaatatacatagttttgtattgcctgcgcttggcttacacttcttgcttttataatataggactgtattttctgtcttagaaaaaattgctaggttctagccatcaaacctttggtgctttcttttgttctcctagaatggagaatggtgtgttgggaaacgccttggaaggtgtgcatgtggaagaggaagaaggagaaaaaacagaagatgaatctctggtagaaaataatgataacatagatgggtatgtggagttgcatgtgacattcaagagatgcgacgttgtatatt

SEQ ID NO: 301992 - DNA, 3131 bp, Homo sapiens
  misc_feature (13)..(13): n is a, c, g, or t
  misc_feature (96)..(96): n is a, c, g, or t
ggggggggggccncccccccaaaatcccccccgggaaaaaagggtgggttcccgggaaaaaggaaacgaaaccgggaaaggttggccccccccggngatggggaggctgccaaacccgcgctggggaaagggccgcctccgggcgccccatcccgctgcggacggaggtgaggttggagcgagcgctggcggaagagaggctcagcgcagggggcgcagagccggcgctggccaatatgcgccgcatgtgatacctttgagggcgcggcgggggagggtagcgtcaaatttcaaaaaaaaaaaaaaaccaaacccacacagccccggcgggcgggcgcgcgcgatgggcgccctttggctgcgggagcgagtggaggatgctgggaaggaggtaaaatggccaccggcggcggcgcggaggaagagaggaaacgggggcggccgcagcttctgccccccgcgcggcccgcggcccggggcgaggaggccgacggcggccgcgagaagatgggctgggcccaggtggtgaagaatctagccgagaagaagggcgaattccgcgagccgcggccgccgcggcgggaggaggaaagcggcggcggtggagggagcgccgggctcggcggccccgcgggcctggcggcgccggacctcggcgacttcccaccggctggccgcggggatccgaagggccgtcggagagatccggccggcgaggcggtggacccccgcaaaaagaagggcgctgcggaggcgggcaggaggaagaaggccgaggcggcggcggccgccatggcgaccccggccaggcccggcgaggccgaggacgcggccgagcggcccctccaggatgagccggcggcggcggcaggcccgggcaagggtcgcttcctcgtccgcatctgtttccagggagacgagggcgcctgcccgacccgggacttcgtggtaggagcgcttatcctgcgctccatcggcatggacccgagcgacatctacgcggtcatccagatcccgggcagccgcgaattcgacgtgagcttccgctcagcggagaagctggccctgttcctacgcgtctacgaggagaagcgggagcaggaggactgctgggagaactttgtggtgctggggcggagcaagtccagcttgaagacgctcttcatcctcttccggaacgagacggtggacgtggaggacattgtgacttggctcaagcgccactgcgacgtgctggccgtgccggtgaaagtgaccgacaggtttgggatctggaccggggagtacaaatgcgagatcgagctgcgccagggggagggcggggtcaggcacttgccaggggccttcttcctgggggccgagaggggctacagctggtacaaggggcagcccaagacatgctttaaatgtggttcccggacccacatgagcggcagctgcacgcaggacaggtgcttcaggtgcggggaggaggggcacctgagcccttactgccggaagggcatcgtgtgcaacctctgtggcaagcgaggacacgcctttgcccagtgtcccaaagcagtgcacaattccgtggcagctcagctaaccggcgtggccgggcactaaacacccgcctgcctgccagggtgaacacacagccagcttacccctcttaagtgccaaaacttttttttaaaccattttttatcgtttttgaaggagatctttttaaaacctacaagagacatctctctatgccttcttaaaccgagtttactccatttcagcctgttctgaattggtgactctgtcaccaataacgactgcggagaactgtagcgtgcagatgtgttgcccctcccttttaaaattttattttcgtttttctattgggtatttgttttgtttcttgtactttttctctctctccttgcccccctcccgccctccccgccccataccttttcttcccctggattttcaccctttgggctgccttgctcatctttatgccccagcactaggtacggggcccaacacgtggtaggcactccatcagtgtttgctgaattgaaaacattgttgactgtggcttctatcagagtgtctaccttttgcagctcttcccctccctcatttaatttgctgcttttaatctacgtggtctgagaatttgtgaaaccagtgttgttagaagtgtatataatctgaatcaataagctctgaatggtggccaagggcctctcttatggcacaaagatgcatggacttcatgacagctcttttggtggctcagaagccattttttatagaatcatggaatctagaatattcctgctggaaagaacctgagagttggtttggaccaattccctggttttccagcagatgaaacaggcccaaagaggttaaatgactgggtgaaaatcacatagctgtctggtgccagagccagcctatagtagagtcccctgaccccaagcccggtgctcattccactacctctcacacttcacaacaatttcctcaacacttgagggcccagaaagtctgatctctccagaatgatcagcccagaggaatgctgagaaatcacctggaggagggagcagaaagagaaggtttttaaggaggggcttctgaatacttgggagatacggaacggaccaaggaccacactccagggtgcattcgttgctccctggggcaccacttctggattacagtgtgccaggtcctttggaggccctaccccttccccattcattgccaccagtgagaaatgggggtgcccctgtgtaaagaaacctaccaaaggtttacatttgcaccttagcctcaatagctacgaaccctagagaagcagctagctggagctcatgtgcaactcctgattctcaggagaaagatggattttaacccaaaattatgagtgagctgttaactctaaaatgtacttgggagataggccaagcgagaggtcatgggccaactaagtgttatccagtagaaaagacagtacactgcttttcttttagtgtttgcttttcctttgctatatgttttgctatttccttgtggcttagaatgtaaaattgattgttaaaagttttgttctgaataaatatttatcttttgtattgctaaaa

SEQ ID NO: 301993 - DNA, 3297 bp, Homo sapiens
tgtgacagagtaaaattttaatgataaaaagttaatggtaaaatgttcactgtaaaactttcaacttttcttcttgaaaacgtgcataatccgacgtgggaaaaaaaataacgcattgcagtcagttctggggaaacggaaagctaagttttaattttgctattgcttttgcttttttaacagaaaaggtacaaaaaagaaaaaatgggagagatgttgccgaactccgtcccgcctgtgggctgtgggccgttagcaaagctgctagcatgaaatcgtcgagcaccgcttgcgaaacgccaaatcctcgagagcgaggccggaggctgccaaacccgcgctggggaaagggccgcctccgggcgccccatcccgctgcggacggaggtgaggttggagcgagcgctggcggaagagaggctcagcgcagggggcgcagagccggcgctggccaatatgcgccgcatgtgatacctttgagggcgcggcgggggagggtagcgtcaaatttcaaaaaaaaaaaaaaaccaaacccacacagccccggcgggcgggcgcgcgcgatgggcgccctttggctgcgggagcgagtggaggatgctgggaaggaggtaaaatggccaccggcggcggcgcggaggaagagaggaaacgggggcggccgcagcttctgccccccgcgcggcccgcggcccggggcgaggaggccgacggcggccgcgagaagatgggctgggcccaggtggtgaagaatctagccgagaagaagggcgaattccgcgagccgcggccgccgcggcgggaggaggaaagcggcggcggtggagggagcgccgggctcggcggccccgcgggcctggcggcgccggacctcggcgacttcccaccggctggccgcggggatccgaagggccgtcggagagatccggccggcgaggcggtggacccccgcaaaaagaagggcgctgcggaggcgggcaggaggaagaaggccgaggcggcggcggccgccatggcgaccccggccaggcccggcgaggccgaggacgcggccgagcggcccctccaggatgagccggcggcggcggcaggcccgggcaagggtcgcttcctcgtccgcatctgtttccagggagacgagggcgcctgcccgacccgggacttcgtggtaggagcgcttatcctgcgctccatcggcatggacccgagcgacatctacgcggtcatccagatcccgggcagccgcgaattcgacgtgagcttccgctcagcggagaagctggccctgttcctacgcgtctacgaggagaagcgggagcaggaggactgctgggagaactttgtggtgctggggcggagcaagtccagcttgaagacgctcttcatcctcttccggaacgagacggtggacgtggaggacattgtgacttggctcaagcgccactgcgacgtgctggccgtgccggtgaaagtgaccgacaggtttgggatctggaccggggagtacaaatgcgagatcgagctgcgccagggggagggcggggtcaggcacttgccaggggccttcttcctgggggccgagaggggctacagctggtacaaggggcagcccaagacatgctttaaatgtggttcccggacccacatgagcggcagctgcacgcaggacaggtgcttcaggtgcggggaggaggggcacctgagcccttactgccggaagggcatcgtgtgcaacctctgtggcaagcgaggacacgcctttgcccagtgtcccaaagcagtgcacaattccgtggcagctcagctaaccggcgtggccgggcactaaacacccgcctgcctgccagggtgaacacacagccagcttacccctcttaagtgccaaaacttttttttaaaccattttttatcgtttttgaaggagatctttttaaaacctacaagagacatctctctatgccttcttaaaccgagtttactccatttcagcctgttctgaattggtgactctgtcaccaataacgactgcggagaactgtagcgtgcagatgtgttgcccctcctttttctctctctccttgcccccctcccgccctccccgccccataccttttcttcccctggattttcaccctttgggctgccttgctcatctttatgccccagcactaggtacggggcccaacacgtggtaggcactccatcagtgtttgctgaattgaaaacattgttgactgtggcttctatcagagtgtctaccttttgcagctcttcccctccctcatttaatttgctgcttttaatctacgtggtctgagaatttgtgaaaccagtgttgttagaagtgtatataatctgaatcaataagctctgaatggtggccaagggcctctcttatggcacaaagatgcatggacttcatgacagctcttttggtggctcagaagccattttttatagaatcatggaatctagaatattcctgctggaaagaacctgagagttggtttggaccaattccctggttttccagcagatgaaacaggcccaaagaggttaaatgactgggtgaaaatcacatagctgtctggtgccagagccagcctatagtagagtcccctgaccccaagcccggtgctcattccactacctctcacacttcacaacaatttcctcaacacttgagggcccagaaagtctgatctctccagaatgatcagcccagaggaatgctgagaaatcacctggaggagggagcagaaagagaaggtttttaaggaggggcttctgaatacttgggagatacggaacggaccaaggaccacactccagggtgcattcgttgctccctggggcaccacttctggattacagtgtgccaggtcctttggaggccctaccccttccccattcattgccaccagtgagaaatgggggtgcccctgtgtaaagaaacctaccaaaggtttacatttgcaccttagcctcaatagctacgaaccctagagaagcagctagctggagctcatgtgcaactcctgattctcaggagaaagatggattttaacccaaaattatgagtgagctgttaactctaaaatgtacttgggagataggccaagcgagaggtcatgggccaactaagtgttatccagtagaaaagacagtacactgcttttcttttagtgtttgcttttcctttgctatatgttttgctatttccttgtggcttagaatgtaaaattgattgttaaaagttttgttctgaataaatatttatcttttgtattgctaaaa

SEQ ID NO: 301994 - DNA, 2919 bp, Homo sapiens
tgtgacagagtaaaattttaatgataaaaagttaatggtaaaatgttcactgtaaaactttcaacttttcttcttgaaaacgtgcataatccgacgtgggaaaaaaaataacgcattgcagtcagttctggggaaacggaaagctaagttttaattttgctattgcttttgcttttttaacagaaaaggtacaaaaaagaaaaaatgggagagatgttgccgaactccgtcccgcctgtgggctgtgggccgttagcaaagctgctagcatgaaatcgtcgagcaccgcttgcgaaacgccaaatcctcgagagcgaggccggaggctgccaaacccgcgctggggaaagggccgcctccgggcgccccatcccgctgcggacggaggtgaggttggagcgagcgctggcggaagagaggctcagcgcagggggcgcagagccggcgctggccaatatgcgccgcatgtgatacctttgagggcgcggcgggggagggtagcgtcaaatttcaaaaaaaaaaaaaaaccaaacccacacagccccggcgggcgggcgcgcgcgatgggcgccctttggctgcgggagcgagtggaggatgctgggaaggaggtaaaatggccaccggcggcggcgcggaggaagagaggaaacgggggcggccgcagcttctgccccccgcgcggcccgcggcccggggcgaggaggccgacggcggccgcgagaagatgggctgggcccaggtggtgaagaatctagccgagaagaagggcgaattccgcgagccgcggccgccgcggcgggaggaggaaagcggcggcggtggagggagcgccgggctcggcggccccgcgggcctggcggcgccggacctcggcgacttcccaccggctggccgcggggatccgaagggccgtcggagagatccggccggcgaggcggtggacccccgcaaaaagaagggcgctgcggaggcgggcaggaggaagaaggccgaggcggcggcggccgccatggcgaccccggccaggcccggcgaggccgaggacgcggccgagcggcccctccaggatgagccggcggcggcggcaggcccgggcaagggtcgcttcctcgtccgcatctgtttccagggagacgagggcgcctgcccgacccgggacttcgtggtaggagcgcttatcctgcgctccatcggcatggacccgagcgacatctacgcggtcatccagatcccgggcagccgcgaattcgacgtgagcttccgctcagcggagaagctggccctgttcctacgcgtctacgaggagaagcgggagcaggaggactgctgggagaactttgtggtgctggggcggagcaagtccagcttgaagacgctcttcatcctcttccggaacgagacggtggacgtggaggacattgtgacttggctcaagcgccactgcgacgtgctggccgtgccggtgaaagtgaccgacaggtttgggatctggaccggggagtacaaatgcgagatcgagctgcgccagggggagggcggggtcaggcacttgccaggggccttcttcctgggggccgagaggggctacagctggtacaaggggcagcccaagacatgctttaaatgtggttcccggacccacatgagcggcagctgcacgcaggacaggtgcttcaggtgcggggaggaggggcacctgagcccttactgccggaagggcatcgtgtgcaacctctgtggcaagcgaggacacgcctttgcccagtgtcccaaagcagtgcacaattccgtggcagctcagctaaccggcgtggccgggcactaaacacccgcctgcctgccagggtgaacacacagccagcttacccctcttaagtgccaaaacttttttttaaaccattttttatcgtttttgaaggagatctttttaaaacctacaagagacatctctctatgccttcttaaaccgagtttactccatttcagcctgttctgaattggtgactctgtcaccaataacgactgcggagaactgtagcgtgcagatgtgttgcccctcccttttaaaattttattttcgtttttctattgggtatttgttttgtttcttgtactttttctctctctccttgcccccctcccgccctccccgccccataccttttcttcccctggattttcaccctttgggctgccttgctcatctttatgccccagcactaggtacggggcccaacacgtggtaggcactccatcagtgtttgctgaattgaaaacattgttgactgtggcttctatcagagtgtctaccttttgcagctcttcccctccctcatttaatttgctgcttttaatctacgtggtctgagaatttgtgaaaccagtgttgttagaagtgtatataatctgaatacttgggagatacggaacggaccaaggaccacactccagggtgcattcgttgctccctggggcaccacttctggattacagtgtgccaggtcctttggaggccctaccccttccccattcattgccaccagtgagaaatgggggtgcccctgtgtaaagaaacctaccaaaggtttacatttgcaccttagcctcaatagctacgaaccctagagaagcagctagctggagctcatgtgcaactcctgattctcaggagaaagatggattttaacccaaaattatgagtgagctgttaactctaaaatgtacttgggagataggccaagcgagaggtcatgggccaactaagtgttatccagtagaaaagacagtacactgcttttcttttagtgtttgcttttcctttgctatatgttttgctatttccttgtggcttagaatgtaaaattgattgttaaaagttttgttctgaataaatatttatcttttgtattgctaaaa

SEQ ID NO: 301995 - DNA, 3351 bp, Homo sapiens
tgtgacagagtaaaattttaatgataaaaagttaatggtaaaatgttcactgtaaaactttcaacttttcttcttgaaaacgtgcataatccgacgtgggaaaaaaaataacgcattgcagtcagttctggggaaacggaaagctaagttttaattttgctattgcttttgcttttttaacagaaaaggtacaaaaaagaaaaaatgggagagatgttgccgaactccgtcccgcctgtgggctgtgggccgttagcaaagctgctagcatgaaatcgtcgagcaccgcttgcgaaacgccaaatcctcgagagcgaggccggaggctgccaaacccgcgctggggaaagggccgcctccgggcgccccatcccgctgcggacggaggtgaggttggagcgagcgctggcggaagagaggctcagcgcagggggcgcagagccggcgctggccaatatgcgccgcatgtgatacctttgagggcgcggcgggggagggtagcgtcaaatttcaaaaaaaaaaaaaaaccaaacccacacagccccggcgggcgggcgcgcgcgatgggcgccctttggctgcgggagcgagtggaggatgctgggaaggaggtaaaatggccaccggcggcggcgcggaggaagagaggaaacgggggcggccgcagcttctgccccccgcgcggcccgcggcccggggcgaggaggccgacggcggccgcgagaagatgggctgggcccaggtggtgaagaatctagccgagaagaagggcgaattccgcgagccgcggccgccgcggcgggaggaggaaagcggcggcggtggagggagcgccgggctcggcggccccgcgggcctggcggcgccggacctcggcgacttcccaccggctggccgcggggatccgaagggccgtcggagagatccggccggcgaggcggtggacccccgcaaaaagaagggcgctgcggaggcgggcaggaggaagaaggccgaggcggcggcggccgccatggcgaccccggccaggcccggcgaggccgaggacgcggccgagcggcccctccaggatgagccggcggcggcggcaggcccgggcaagggtcgcttcctcgtccgcatctgtttccagggagacgagggcgcctgcccgacccgggacttcgtggtaggagcgcttatcctgcgctccatcggcatggacccgagcgacatctacgcggtcatccagatcccgggcagccgcgaattcgacgtgagcttccgctcagcggagaagctggccctgttcctacgcgtctacgaggagaagcgggagcaggaggactgctgggagaactttgtggtgctggggcggagcaagtccagcttgaagacgctcttcatcctcttccggaacgagacggtggacgtggaggacattgtgacttggctcaagcgccactgcgacgtgctggccgtgccggtgaaagtgaccgacaggtttgggatctggaccggggagtacaaatgcgagatcgagctgcgccagggggagggcggggtcaggcacttgccaggggccttcttcctgggggccgagaggggctacagctggtacaaggggcagcccaagacatgctttaaatgtggttcccggacccacatgagcggcagctgcacgcaggacaggtgcttcaggtgcggggaggaggggcacctgagcccttactgccggaagggcatcgtgtgcaacctctgtggcaagcgaggacacgcctttgcccagtgtcccaaagcagtgcacaattccgtggcagctcagctaaccggcgtggccgggcactaaacacccgcctgcctgccagggtgaacacacagccagcttacccctcttaagtgccaaaacttttttttaaaccattttttatcgtttttgaaggagatctttttaaaacctacaagagacatctctctatgccttcttaaaccgagtttactccatttcagcctgttctgaattggtgactctgtcaccaataacgactgcggagaactgtagcgtgcagatgtgttgcccctcccttttaaaattttattttcgtttttctattgggtatttgttttgtttcttgtactttttctctctctccttgcccccctcccgccctccccgccccataccttttcttcccctggattttcaccctttgggctgccttgctcatctttatgccccagcactaggtacggggcccaacacgtggtaggcactccatcagtgtttgctgaattgaaaacattgttgactgtggcttctatcagagtgtctaccttttgcagctcttcccctccctcatttaatttgctgcttttaatctacgtggtctgagaatttgtgaaaccagtgttgttagaagtgtatataatctgaatcaataagctctgaatggtggccaagggcctctcttatggcacaaagatgcatggacttcatgacagctcttttggtggctcagaagccattttttatagaatcatggaatctagaatattcctgctggaaagaacctgagagttggtttggaccaattccctggttttccagcagatgaaacaggcccaaagaggttaaatgactgggtgaaaatcacatagctgtctggtgccagagccagcctatagtagagtcccctgaccccaagcccggtgctcattccactacctctcacacttcacaacaatttcctcaacacttgagggcccagaaagtctgatctctccagaatgatcagcccagaggaatgctgagaaatcacctggaggagggagcagaaagagaaggtttttaaggaggggcttctgaatacttgggagatacggaacggaccaaggaccacactccagggtgcattcgttgctccctggggcaccacttctggattacagtgtgccaggtcctttggaggccctaccccttccccattcattgccaccagtgagaaatgggggtgcccctgtgtaaagaaacctaccaaaggtttacatttgcaccttagcctcaatagctacgaaccctagagaagcagctagctggagctcatgtgcaactcctgattctcaggagaaagatggattttaacccaaaattatgagtgagctgttaactctaaaatgtacttgggagataggccaagcgagaggtcatgggccaactaagtgttatccagtagaaaagacagtacactgcttttcttttagtgtttgcttttcctttgctatatgttttgctatttccttgtggcttagaatgtaaaattgattgttaaaagttttgttctgaataaatatttatcttttgtattgctaaaa

SEQ ID NO: 301996 - DNA, 3103 bp, Homo sapiens
  misc_feature (1)..(2): n is a, c, g, or t
  misc_feature (35)..(35): n is a, c, g, or t
  misc_feature (62)..(62): n is a, c, g, or t
  misc_feature (69)..(69): n is a, c, g, or t
nnccccccgggggggggggcccccaacccccgggnaaaggggggcccggaaaagaaaagggnccccggnaaagggaggctgccaaacccgcgctggggaaagggccgcctccgggcgccccatcccgctgcggacggaggtgaggttggagcgagcgctggcggaagagaggctcagcgcagggggcgcagagccggcgctggccaatatgcgccgcatgtgatacctttgagggcgcggcgggggagggtagcgtcaaatttcaaaaaaaaaaaaaaaccaaacccacacagccccggcgggcgggcgcgcgcgatgggcgccctttggctgcgggagcgagtggaggatgctgggaaggaggtaaaatggccaccggcggcggcgcggaggaagagaggaaacgggggcggccgcagcttctgccccccgcgcggcccgcggcccggggcgaggaggccgacggcggccgcgagaagatgggctgggcccaggtggtgaagaatctagccgagaagaagggcgaattccgcgagccgcggccgccgcggcgggaggaggaaagcggcggcggtggagggagcgccgggctcggcggccccgcgggcctggcggcgccggacctcggcgacttcccaccggctggccgcggggatccgaagggccgtcggagagatccggccggcgaggcggtggacccccgcaaaaagaagggcgctgcggaggcgggcaggaggaagaaggccgaggcggcggcggccgccatggcgaccccggccaggcccggcgaggccgaggacgcggccgagcggcccctccaggatgagccggcggcggcggcaggcccgggcaagggtcgcttcctcgtccgcatctgtttccagggagacgagggcgcctgcccgacccgggacttcgtggtaggagcgcttatcctgcgctccatcggcatggacccgagcgacatctacgcggtcatccagatcccgggcagccgcgaattcgacgtgagcttccgctcagcggagaagctggccctgttcctacgcgtctacgaggagaagcgggagcaggaggactgctgggagaactttgtggtgctggggcggagcaagtccagcttgaagacgctcttcatcctcttccggaacgagacggtggacgtggaggacattgtgacttggctcaagcgccactgcgacgtgctggccgtgccggtgaaagtgaccgacaggtttgggatctggaccggggagtacaaatgcgagatcgagctgcgccagggggagggcggggtcaggcacttgccaggggccttcttcctgggggccgagaggggctacagctggtacaaggggcagcccaagacatgctttaaatgtggttcccggacccacatgagcggcagctgcacgcaggacaggtgcttcaggtgcggggaggaggggcacctgagcccttactgccggaagggcatcgtgtgcaacctctgtggcaagcgaggacacgcctttgcccagtgtcccaaagcagtgcacaattccgtggcagctcagctaaccggcgtggccgggcactaaacacccgcctgcctgccagggtgaacacacagccagcttacccctcttaagtgccaaaacttttttttaaaccattttttatcgtttttgaaggagatctttttaaaacctacaagagacatctctctatgccttcttaaaccgagtttactccatttcagcctgttctgaattggtgactctgtcaccaataacgactgcggagaactgtagcgtgcagatgtgttgcccctcccttttaaaattttattttcgtttttctattgggtatttgttttgtttcttgtactttttctctctctccttgcccccctcccgccctccccgccccataccttttcttcccctggattttcaccctttgggctgccttgctcatctttatgccccagcactaggtacggggcccaacacgtggtaggcactccatcagtgtttgctgaattgaaaacattgttgactgtggcttctatcagagtgtctaccttttgcagctcttcccctccctcatttaatttgctgcttttaatctacgtggtctgagaatttgtgaaaccagtgttgttagaagtgtatataatctgaatcaataagctctgaatggtggccaagggcctctcttatggcacaaagatgcatggacttcatgacagctcttttggtggctcagaagccattttttatagaatcatggaatctagaatattcctgctggaaagaacctgagagttggtttggaccaattccctggttttccagcagatgaaacaggcccaaagaggttaaatgactgggtgaaaatcacatagctgtctggtgccagagccagcctatagtagagtcccctgaccccaagcccggtgctcattccactacctctcacacttcacaacaatttcctcaacacttgagggcccagaaagtctgatctctccagaatgatcagcccagaggaatgctgagaaatcacctggaggagggagcagaaagagaaggtttttaaggaggggcttctgaatacttgggagatacggaacggaccaaggaccacactccagggtgcattcgttgctccctggggcaccacttctggattacagtgtgccaggtcctttggaggccctaccccttccccattcattgccaccagtgagaaatgggggtgcccctgtgtaaagaaacctaccaaaggtttacatttgcaccttagcctcaatagctacgaaccctagagaagcagctagctggagctcatgtgcaactcctgattctcaggagaaagatggattttaacccaaaattatgagtgagctgttaactctaaaatgtacttgggagataggccaagcgagaggtcatgggccaactaagtgttatccagtagaaaagacagtacactgcttttcttttagtgtttgcttttcctttgctatatgttttgctatttccttgtggcttagaatgtaaaattgattgttaaaagttttgttctgaataaatatttatcttttgtattgctaaaa

SEQ ID NO: 301997 - DNA, 3407 bp, Homo sapiens
  misc_feature (3362)..(3362): n is a, c, g, or t
tgtgacagagtaaaattttaatgataaaaagttaatggtaaaatgttcactgtaaaactttcaacttttcttcttgaaaacgtgcataatccgacgtgggaaaaaaaataacgcattgcagtcagttctggggaaacggaaagctaagttttaattttgctattgcttttgcttttttaacagaaaaggtacaaaaaagaaaaaatgggagagatgttgccgaactccgtcccgcctgtgggctgtgggccgttagcaaagctgctagcatgaaatcgtcgagcaccgcttgcgaaacgccaaatcctcgagagcgaggccggaggctgccaaacccgcgctggggaaagggccgcctccgggcgccccatcccgctgcggacggaggtgaggttggagcgagcgctggcggaagagaggctcagcgcagggggcgcagagccggcgctggccaatatgcgccgcatgtgatacctttgagggcgcggcgggggagggtagcgtcaaatttcaaaaaaaaaaaaaaaccaaacccacacagccccggcgggcgggcgcgcgcgatgggcgccctttggctgcgggagcgagtggaggatgctgggaaggaggtaaaatggccaccggcggcggcgcggaggaagagaggaaacgggggcggccgcagcttctgccccccgcgcggcccgcggcccggggcgaggaggccgacggcggccgcgagaagatgggctgggcccaggtggtgaagaatctagccgagaagaagggcgaattccgcgagccgcggccgccgcggcgggaggaggaaagcggcggcggtggagggagcgccgggctcggcggccccgcgggcctggcggcgccggacctcggcgacttcccaccggctggccgcggggatccgaagggccgtcggagagatccggccggcgaggcggtggacccccgcaaaaagaagggcgctgcggaggcgggcaggaggaagaaggccgaggcggcggcggccgccatggcgaccccggccaggcccggcgaggccgaggacgcggccgagcggcccctccaggatgagccggcggcggcggcaggcccgggcaagggtcgcttcctcgtccgcatctgtttccagggagacgagggcgcctgcccgacccgggacttcgtggtaggagcgcttatcctgcgctccatcggcatggacccgagcgacatctacgcggtcatccagatcccgggcagccgcgaattcgacgtgagcttccgctcagcggagaagctggccctgttcctacgcgtctacgaggagaagcgggagcaggaggactgctgggagaactttgtggtgctggggcggagcaagtccagcttgaagacgctcttcatcctcttccggaacgagacggtggacgtggaggacattgtgacttggctcaagcgccactgcgacgtgctggccgtgccggtgaaagtgaccgacaggtttgggatctggaccggggagtacaaatgcgagatcgagctgcgccagggggagggcggggtcaggcacttgccaggggccttcttcctgggggccgagaggggctacagctggtacaaggggcagcccaagacatgctttaaatgtggttcccggacccacatgagcggcagctgcacgcaggacaggtgcttcaggtgcggggaggaggggcacctgagcccttactgccggaagggcatcgtgtgcaacctctgtggcaagcgaggacacgcctttgcccagtgtcccaaagcagtgcacaattccgtggcagctcagctaaccggcgtggccgggcactaaacacccgcctgcctgccagggtgaacacacagccagcttacccctcttaagtgccaaaacttttttttaaaccattttttatcgtttttgaaggagatctttttaaaacctacaagagacatctctctatgccttcttaaaccgagtttactccatttcagcctgttctgaattggtgactctgtcaccaataacgactgcggagaactgtagcgtgcagatgtgttgcccctcccttttaaaattttattttcgtttttctattgggtatttgttttgtttcttgtactttttctctctctccttgcccccctcccgccctccccgccccataccttttcttcccctggattttcaccctttgggctgccttgctcatctttatgccccagcactaggtacggggcccaacacgtggtaggcactccatcagtgtttgctgaattgaaaacattgttgactgtggcttctatcagagtgtctaccttttgcagctcttcccctccctcatttaatttgctgcttttaatctacgtggtctgagaatttgtgaaaccagtgttgttagaagtgtatataatctgaatcaataagctctgaatggtggccaagggcctctcttatggcacaaagatgcatggacttcatgacagctcttttggtggctcagaagccattttttatagaatcatggaatctagaatattcctgctggaaagaacctgagagttggtttggaccaattccctggttttccagcagatgaaacaggcccaaagaggttaaatgactgggtgaaaatcacatagctgtctggtgccagagccagcctatagtagagtcccctgaccccaagcccggtgctcattccactacctctcacacttcacaacaatttcctcaacacttgagggcccagaaagtctgatctctccagaatgatcagcccagaggaatgctgagaaatcacctggaggagggagcagaaagagaaggtttttaaggaggggcttctgaatacttgggagatacggaacggaccaaggaccacactccagggtgcattcgttgctccctggggcaccacttctggattacagtgtgccaggtcctttggaggccctaccccttccccattcattgccaccagtgagaaatgggggtgcccctgtgtaaagaaacctaccaaaggtttacatttgcaccttagcctcaatagctacgaaccctagagaagcagctagctggagctcatgtgcaactcctgattctcaggagaaagatggattttaacccaaaattatgagtgagctgttaactctaaaatgtacttgggagataggccaagcgagaggtcatgggccaactaagtgttatccagtagaaaagacagtacactgcttttcttttagtgtttgcttttcctttgctatatgttttgctatttccttgtggcttagaatgtaaaattgattgttaaaagttttgttctgaataaatatttatcttttgtattgctaaaaaaaaaaaaaanaaaaaaaaaaaaaagcggccgctcgaatcgcggcgcgtcgactac

SEQ ID NO: 301998 - DNA, 529 bp, Homo sapiens
ccaactctgagcctcagttcctctatctgtgaatgggagtaaaattccttccctgtaggaaggggcagttatgtgaaccaatgtgtgcaaagtattgtgcacagagcctgggtcctagaaagtcctcgaaaaatgtcagctggcctcagtacctataacctttctacatcaaagtcttttgagaatctgataaaaactgtggacttggaaaatatatgtatatatatatatgacaacattttccactttgggacagggagtttggctctctaagccatctcttgaatcagatttagaatctctactgaaaatacaaaaattacctgggcgtggcggtgcacatctgtgatcccagctacttgggaggctgaagcacaagaattgcttgaaccccgttgtagtgagccaagatcctgccactgcactccagcctgtgtgacagatcaagactcttgtcttaaaataaaataaaataaaaataataaataaataaataaaagagactgccaggaaaggacagaatctagcc

SEQ ID NO: 301999 - DNA, 718 bp, Homo sapiens
ggaagaaatgggttggattcacttccaaagaaggaggttgcaagttccctagggctaagctacgtatggttaaaaacccagcagcagctcttctccagaccacactagaccactgactgcttcttgggcaaggaactcgtcagtaacttttaagatttccttaacccttcttaccacttttcttagttgatttcttgaggctaatttcctgaggctaactaaactgagactgtccttcctctttggtaagtctgttttattcagatgggcagacagtgtcatttttgagtgatggttgtaaaacagtggcagtccaggcttattacttatagtcatggcaaataaaaagtcaaaataaatgaatgccgaattttttctcccctcttcaaatagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtaagctttatgctgctgaaattgtgtcagtttatatttcataaactttcttatcctaattgaagtgctagacgaccacagtatagtaaaatgtaattgtttgtatacatttaagttttgtaaaattggttttttaaaatttggaaatgaagctcttacccaaagagtgtgttt

SEQ ID NO: 302000 - DNA, 839 bp, Homo sapiens
ggaagaaatgggttggattcacttccaaagaaggaggttgcaagttccctagggctaagctacgtatggttaaaaacccagcagcagctcttctccagaccacactagaccactgactgcttcttgggcaaggaactcgtcagtaacttttaagatttccttaacccttcttaccacttttcttagttgatttcttgaggctaatttcctgaggctaactaaactgagactgtccttcctctttggtaagtctgttttattcagatgggcagacagtgtcatttttgagtgatggttgtaaaacagtggcagtccaggcttattacttatagtcatggcaaataaaaagtcaaaataaatgaatgccgaattttttctcccctcttcaaatagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtaagctttatgctgctgaaattgtgtcagtttatatttcataaactttcttatcctaattgaagtgctagacgaccacagtatagtaaaatgtaattgtttgtatacatttaagttttgtaaaattggttttttaaaatttggaaatgaagctcttacccaaagagtgtgttttttactattttatttcaaattatataggaaaaaaagtgaagcattatatcatcttgattagtatactaatgacaaaaattaatttctatttgatttaggctatatgagtttagagtagggt

SEQ ID NO: 302001 - DNA, 512 bp, Homo sapiens
  misc_feature (462)..(462): n is a, c, g, or t
  misc_feature (490)..(490): n is a, c, g, or t
gggcagtagagcgaccctgtctcaaaaaaacaaaaaaacaaaaaacctgaacttgatttcaaggagtaaataacagcagtgcttgctcatgtctcagtggatctgtaataagttcacttttgatgaggcttactaatgtgcctttttcactcctccttccaccattattaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggacaccgaagggttatcagagaattatccgtcnagttggactgtaccagcactcattcggnacgtcctataatggggcgttcc

SEQ ID NO: 302002 - DNA, 8218 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302003 - DNA, 7899 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302004 - DNA, 7882 bp, Homo sapiens
agttaataggctggctgtcgcttggggttgctgcataaatgctaggagcagcagctctatggttatgaggtggggagaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302005 - DNA, 7158 bp, Homo sapiens
ttcctacctctgaacgacatccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302006 - DNA, 7597 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302007 - DNA, 7628 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302008 - DNA, 8241 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgtaaaaaaaaaaaacaaaaaaaaaaa

SEQ ID NO: 302009 - DNA, 8063 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgactatgagcaaagagctcattta

SEQ ID NO: 302010 - DNA, 8102 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttctactcttcccatgttacaaagtgggaccaaatgagtccctttctgaacatgatcaattaagaagagccctacatctggttgagtcctttggtaacggtcataatactcacaaggtcgac

SEQ ID NO: 302011 - DNA, 8086 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttaaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302012 - DNA, 8179 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302013 - DNA, 5104 bp, Homo sapiens
tgccaaagcgtagtacccaatacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302014 - DNA, 7881 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302015 - DNA, 5953 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggcggatggattgcttgagcccaggagttcaagaccagcctgggcaacgtggcgaaaccctgtctctaccaaa

SEQ ID NO: 302016 - DNA, 5824 bp, Homo sapiens
agttaataggctggctgtcgcttggggttgctgcataaatgctaggagcagcagctctatggttatgaggtggggagaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtcagcaatagtcctgaacctcagaaggctgtagaacaggaggtgagaatggtgcttcttaacattttgcaaaaagtatactaaagtgattaactattgattacttcctcaactgctattctcaagacatcagatgctcagcttggaagactattgttgtaattcactgaaatataaaagaaaattatttccactgtagtggttgtcagggctttactgcaatctgtaatttattccttccccaaagtaagcatttttaaataaaggaaagaaaatataagtaaattctgtgaaattcagcctgtttgcatttatccagctctatgtaatggtatactttccagaaataccttcttcagggcataatgtatgtaacttgtatttgtcctgaatgtggcctagtgtgtcatcttacagtggactgcttccttagtttaatagagttcttcatctccagtcagggcaccatccagctttattcatcaaacatctgttaagagcctactacaggccaggtgtggtggctcatgcctgaaatcccagcactctgcccaggcaggcggatcacttggtcaggagtaggagttcaagaccagcatggccagtatggtgaaatcttgtctctactaaaaatacaaaaatcagccaggcatggtggcagacacctgtaatcccaggtacttaggagtctgaggcaggagaattgcttgaacccgggaggtggaggttgcagtgagctaagatggtgccactgccttccagcctgggcaacacagcgagactccatctcaaaacagacaaacaagcaaaaaatagattaaagtctggatttcactgattttcttgcttaataagttttttaaaaccacgatgctgtgaaattctttgtggcagtcccgtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302017 - DNA, 5067 bp, Homo sapiens
catcagtctggtatcaataaaagctgctctattgtagtggctggattcttgtaagcacaactttttaccaaccccctcaagggaaatattcttactgtgagggagaaaaatcagaagataaactataaagaaagactttatttgcaaatatacccatttactttaaactgtataatggttagttttctaacatgtgcattaaaaacaaaacaagaaacaactaagattcaaatttgttttttttttaactaaaattattttttaaatgaatagatgtgtttaaaaaataagcttacttattgctagactggcaaaatcccctactccatttactgaggtacttaaaaataactagcatgctgtatctctttttttcccagctttgtcttgaattggcattgccatccttgttttatctcaactggctgtagcttttagataatatcataaggattaaccagtaacctcttacattcattactgttttctaggggaaaatatttggtatttggtttttctgttgcagcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302018 - DNA, 6160 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtcagcaatagtcctgaacctcagaaggctgtagaacaggaggtgagaatggtgcttcttaacattttgcaaaaagtatactaaagtgattaactattgattacttcctcaactgctattctcaagacatcagatgctcagcttggaagactattgttgtaattcactgaaatataaaagaaaattatttccactgtagtggttgtcagggctttactgcaatctgtaatttattccttccccaaagtaagcatttttaaataaaggaaagaaaatataagtaaattctgtgaaattcagcctgtttgcatttatccagctctatgtaatggtatactttccagaaataccttcttcagggcataatgtatgtaacttgtatttgtcctgaatgtggcctagtgtgtcatcttacagtggactgcttccttagtttaatagagttcttcatctccagtcagggcaccatccagctttattcatcaaacatctgttaagagcctactacaggccaggtgtggtggctcatgcctgaaatcccagcactctgcccaggcaggcggatcacttggtcaggagtaggagttcaagaccagcatggccagtatggtgaaatcttgtctctactaaaaatacaaaaatcagccaggcatggtggcagacacctgtaatcccaggtacttaggagtctgaggcaggagaattgcttgaacccgggaggtggaggttgcagtgagctaagatggtgccactgccttccagcctgggcaacacagcgagactccatctcaaaacagacaaacaagcaaaaaatagattaaagtctggatttcactgattttcttgcttaataagttttttaaaaccacgatgctgtgaaattctttgtggcagtcccgtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302019 - DNA, 6106 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtcagcaatagtcctgaacctcagaaggctgtagaacaggaggtgagaatggtgcttcttaacattttgcaaaaagtatactaaagtgattaactattgattacttcctcaactgctattctcaagacatcagatgctcagcttggaagactattgttgtaattcactgaaatataaaagaaaattatttccactgtagtggttgtcagggctttactgcaatctgtaatttattccttccccaaagtaagcatttttaaataaaggaaaggtaatggtatactttccagaaataccttcttcagggcataatgtatgtaacttgtatttgtcctgaatgtggcctagtgtgtcatcttacagtggactgcttccttagtttaatagagttcttcatctccagtcagggcaccatccagctttattcatcaaacatctgttaagagcctactacaggccaggtgtggtggctcatgcctgaaatcccagcactctgcccaggcaggcggatcacttggtcaggagtaggagttcaagaccagcatggccagtatggtgaaatcttgtctctactaaaaatacaaaaatcagccaggcatggtggcagacacctgtaatcccaggtacttaggagtctgaggcaggagaattgcttgaacccgggaggtggaggttgcagtgagctaagatggtgccactgccttccagcctgggcaacacagcgagactccatctcaaaacagacaaacaagcaaaaaatagattaaagtctggatttcactgattttcttgcttaataagttttttaaaaccacgatgctgtgaaattctttgtggcagtcccgtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccagcactttaggaggctgaggcggatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcgccacgttggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302020 - DNA, 4685 bp, Homo sapiens
agttaataggctggctgtcgcttggggttgctgcataaatgctaggagcagcagctctatggttatgaggtggggagaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaaaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtgtgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302021 - DNA, 5229 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 302022 - DNA, 4743 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactattta

SEQ ID NO: 302023 - DNA, 3065 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgaggtataataatgggtcatcaacttaggcaactgggtgaagtgcacaaataaaaggaaccaaaataatctcaaacagtcaaaagatttccactaattagtgtcactgtggtggattaaaagatacctattcttgtgata

SEQ ID NO: 302024 - DNA, 4332 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttcctcacccatttcccctcatatcctccctatatcatgtctcttttgatcacatgagcatcatcacatccatcttaaacctttattccttgctcactggtatactactagatgcccctccccatcacactcatatcatatggtaccgagctcgattctatctt

SEQ ID NO: 302025 - DNA, 4606 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaagtaagtatatttttagataactgccatggaacaaataggagaattataggaaatagttatgtctgaaattcaaatctgtgttagctcagaaaatcagtgatggcaaagatctagctatagttacttcactcaatgaaacttataaattctaggaaaataagttttcatgtatcaagaccaatactcataattaaaagtttttcgttgtcaaaacattttcacagttcaggaatcacagtcctatttcatcttttgaaataaaagttaaagtccatttttcttaagccttattataccattatccaaaaacactacctagcattcatcttagtttttcatatctccttagcagatagtttagtatattccatttgtcttatttgaggtttaaaaaaagttgtggaagaagtttctcaggagttcagcaagcctttccatctatcttctattttaaaagaatgtgatttattgtttttatgaataaaatatacctcgtgtgtttctcatatgatgttccattacattaatcatccattaagtaaatgtttttgtgttgcaaaattcatggcagggaatggtttaaaagcaaatactgtaagtctataaaatacattaatacatatacacttcaaaatcaccataccttttttcaggccagaggagggagaaagactagaaggtatttcggaagcctttaaaagaaagcaaggtttcaatcccacctgtcttttctgcagttacttataaatcatatttagacctctccttatatcctaagagattccaggatcccctagagttcatttcagttatttgtaagagcttcattttagcatagttattggaacaggatttgttttttaaaacacacacacacagagaaataaaggagaaattttagcatttaggaaatgctgcacattgagttcttagtgttttgattcagattcactaaaattgctttatta

SEQ ID NO: 302026 - DNA, 3414 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatggcggggattggcaatattactcttaactgggagggtcataatcacacgtgcatactggggcatgcacagccggggggcttggacccacttgggggcccaggctgaaaaaaaaattttggggcacccggagaaaacacggcacagcggggggagcgtgcacccggatagcggctattggacacaaaacagggggtgccacaaaacgaag

SEQ ID NO: 302027 - DNA, 3070 bp, Homo sapiens
tccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgaggtataataatgggtcatcaacttaggcaactgggtgaagtgcacaaataaaaggaaccaaaataatctcaaacagtcaaaagatttccaccacagtgacactaattagtggaaatctttgactgttgagattaggaccggcc

SEQ ID NO: 302028 - DNA, 711 bp, Homo sapiens
aaaacaaaaaaacaaaaaacctgaacttgatttcaaggagtaaataacagcagtgcttgctcatgtctcagtggatctgtaataagttcacttttgatgaggcttactaatgtgcctttttcactcctccttccaccattattaggtaaccaatggtcaaggtgaaaataagatgaaaaatttacctgtgcctgtctatctcagacctctggatgaaaaagatacatcaatgaaggtaagttcattgtgaattaaaaggagatgttttctaaactctgggtagttttttttctaaaaccaaaaaagtataagtattacttctatggtgaggttattgttcattttataatattaggttataagacctgtatttacaaccattagttattttaagaaaacatgaaaatgctaaacatttctagacttaatattgttttctttttcacctgagaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggtacgtgtgtgtactaacatttgacctggttatgagactatgagtttaactctttcatccaaaatttgcctctgggtccagcttctaat

SEQ ID NO: 302029 - DNA, 3237 bp, Homo sapiens
agcgggtcactgcgcaggcgcggcccgggagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattaa

SEQ ID NO: 302030 - DNA, 436 bp, Homo sapiens
ggaaaggagactcaatgagttaatactatttcactgagcccaagaatgtgggaatggcagaacagaaagagctatcattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattaa

SEQ ID NO: 302031 - DNA, 3177 bp, Homo sapiens
agcgggtcactgcgcaggcgcggcccgggagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaactgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattaa

SEQ ID NO: 302032 - DNA, 3183 bp, Homo sapiens
agcgggtcactgcgcaggcgcggcccgggagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattaa

SEQ ID NO: 302033 - DNA, 3026 bp, Homo sapiens
agcgggtcactgcgcaggcgcggcccgggagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatctgagatgggaggatcctgagctcaggaggtcaaggctgcaagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattaa

SEQ ID NO: 302034 - DNA, 3603 bp, Homo sapiens
  misc_feature (3250)..(3250): n is a, c, g, or t
agcgggtcactgcgcaggcgcggcccgggagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattaaaaaaaaaaaaaanaaaaaaaaaaaaaaaaaaaaaaaaaaaaaaaaaaaaaaaaaaaaaaaaagggggggggggcgcgcgcacaaagagaagaatatctcccgcgcagggggggcgccaccaataggcgcgcgcgccaccgccacagatttgtgttgaaacaagagagggcggccccatatgagaggaggagcgcggctaattaataaacgaggcggagcgcgcgggggcgcggcggttacacacaacgacgcgggaggagggggagaacaagagcggcggacgcgggggcgactctgtgaggaaggaggacgacacctactccgggggggggggggagaacaaataggggggacacaccaccccag

SEQ ID NO: 302035 - DNA, 3213 bp, Homo sapiens
agcgggtcactgcgcaggcgcggcccgggagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctaacatgcaactcagggcgatccctctag

SEQ ID NO: 302036 - DNA, 3183 bp, Homo sapiens
agcgggtcactgcgcaggcgcggcccgggagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttctttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattaa

SEQ ID NO: 302037 - DNA, 3033 bp, Homo sapiens
agcgcggaggtgggcagatcacaaggtcaggagatcaagaccatcctggctaacatgaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattaa

SEQ ID NO: 302038 - DNA, 3148 bp, Homo sapiens
agcgggtcactgcgcaggcgcggcccgggagcgtggggtatctcgaggtgccgggttgcaggcgctcaggagcgctagggtttgaggcctgctttctgctcgcgccagcagagcactacctgaggcacgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattaa

SEQ ID NO: 302039 - DNA, 3126 bp, Homo sapiens
agcgggtcactgcgcaggcgcggcccgggagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaaagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattaa

SEQ ID NO: 302040 - DNA, 2798 bp, Homo sapiens
agcgggtcactgcgcaggcgcggcccgggagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggcccttatcgagagcccttattggccctttcggggtgg

SEQ ID NO: 302041 - DNA, 2337 bp, Homo sapiens
tctgctccaagctcactcttgtggctgttgacaggaagcttcagtttcttgccatagcccgtctccatatggctactcatggcatggcttcccccaaagcaattggttagagagagagagcccgaagccacagtgcctaatctcagaagtgacaaatcatcacacagaccaacccagtataacatgggaggggactacacaaaggtatgaaataacaggagatagaggttgttgggatcattgtcacggcttgctaccccagacagtgagaggaagaccacgcaaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattaa

SEQ ID NO: 302042 - DNA, 2002 bp, Homo sapiens
agtatttacatcggttcaagaaggtacaactgtaagaatcagattaggctcaaactggcgagaagccatctacatctttcagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattaa

SEQ ID NO: 302043 - DNA, 1749 bp, Homo sapiens
  misc_feature (1396)..(1396): n is a, c, g, or t
agcgggtcactgcgcaggcgcggcccgggagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctaaaaaaaaaaaaanaaaaaaaaaaaaaaaaaaaaaaaaaaaaaaaaaaaaaaaaaaaaaaaaagggggggggggcgcgcgcacaaagagaagaatatctcccgcgcagggggggcgccaccaataggcgcgcgcgccaccgccacagatttgtgttgaaacaagagagggcggccccatatgagaggaggagcgcggctaattaataaacgaggcggagcgcgcgggggcgcggcggttacacacaacgacgcgggaggagggggagaacaagagcggcggacgcgggggcgactctgtgaggaaggaggacgacacctactccgggggggggggggagaacaaataggggggacacaccaccccag

SEQ ID NO: 302044 - DNA, 1287 bp, Homo sapiens
agcgggtcactgcgcaggcgcggcccgggagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagactgaaaatgagggcaggcgcagtggctcatgcctgtgatcccagcgctttgggaggctga

SEQ ID NO: 302045 - DNA, 947 bp, Homo sapiens
agcgggtcactgcgcaggcgcggcccgggagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggttagtaaggatcctaggatctagccattgaggacaaatcatggggaacccacgttattcaggccacttcagatacctctcggtctgaaagaatagctacaaagttacaaattcatttaaagacctggtgatgtgattttcaagaagtattggctatgtattttatagactttccttcggttgaaatctgtctgatgtttctcttacaactagactaaggtgatagatgttgaggagaagaccactgaagtaaagtgcaattcttatcacatcatatcaagagtacatacggccgggcacggtggctcacgcctgtaatcccagcactttgggaggccaaggtgcgtggatcacgaggtcaggagattgagaccatcctggctagcacagtgaaaccctgtctc

SEQ ID NO: 302046 - DNA, 524 bp, Homo sapiens
agcgggtcactgcgcaggcgcggcccgggagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaaggtcagtatcccagcaaatgctcccatctctatacacagttaaggaggtgtggtggtggtttcccttttttaaaaaaatgtatttgtcttacttgttttttgctgatgttcacgcctctgatcctcatgaggtaagctaaattgttttgaaatatatgattagaaaagtcaaagaattggtttaaaatcctgtttcccccatggagaggcagtagatacag

SEQ ID NO: 302047 - DNA, 212 bp, Homo sapiens
gccatgtgtggctgagaaatagaattcttctatttaaatgatattctaaggttgcattcggaacctgaagtggcttttcacattggaatcatttattttcaataggtactctttctacatgctgacgtgcattgacatggattggaaggtgctcacatggcttcgttacactctgtggattcccttatatccactgggatgtttggcggaag

SEQ ID NO: 302048 - DNA, 388 bp, Homo sapiens
aaactttatggtggggatgagtggatggggcaagggtttggggagcaatgatcaactgggtaaaatcctggggagtggcaattgagtgggaagggagtcaagaagtgtttagggaaggatgtcggggaagtgagtaataggtaggtcagaggatggagcaagggaatgttgaaaggcaacggatatgctctgtggacaggtggcaaaatatctgaatgggggcccagggagggctactatggagtaacagggaagggaccctgaggtgctgatttctcagagatagacaatgggattggatatgtgttggtggaggaatgcagaaagcccaggccaactccgaatgccattcatttacatgaaatccctctttatgcctccaccatct

SEQ ID NO: 302049 - DNA, 495 bp, Homo sapiens
gtggtggcgtgtgcctatagtcccagctacttgggaggcggaggtgggaggatcacctgagcccgaaggtcaaggctgcagtgagccgtgattgtgccactgcactccagtctgggtgacagagcaagaccctgtctcaaaaaataaaaacaaaatatcattttttacttaccaagttggcacaaataaaactgataatattcagtgctgatgacagggtaaggaagtagaaattctcaatcactgctggtggaagtataaatgatgtaaccttttggggaagcaacctggtaatagctataaaaatgcaatatgcacgtggtctttaatccagaaattccaagttcagaaatctttcatacaagagtaaaattagcaataaggggccgggcatggtggctcatgcctataatcccagcactttgggaagccgaggcgggtggatcacaaggtcaggagtttgagaccagcctggccaatatggtgaaaccctgt

SEQ ID NO: 302050 - DNA, 711 bp, Homo sapiens
tatataaatatcctcccttgttcatgtgctttggcacgcatatgcaaaagtttctgtaaggagttaaattgcttcgtcattccttatgagtattttcatctttattaaatattgccacattgtttttgcagagtggctgtactggtttacagcctcatcagcaggataggtccccttggcgggattccagtctgcccctttggggaggagggtgtagcagggagagaaataaggctggcaaggaatgagaaagccaggcaggagaacaccattagtgccaatccaaggagttcagactgtatttgactgcattgggaagctactggcaattctggaacagggaacaaaatgcaaaaacagggttttgggaaggttagtctttaaagctgtctcttggtttgtgttggcagttggtagtgatagtggtggggttgacttaggccagcagcaggactcaagctcacaggagagagatctgtagggtgacagcacaaaggggacagtgagcacatccctgggggcagaaaaccagagcatcccagatctcccaactcttatccttaaataatccagttagacacacacactgctagtaggtgtgtgaagtgctacagccactctggaaaacaatgtggccgtatttaacaaagataaatatgcacatactgaatggcccacaagttgtaaaatataccaagcaaaacaaacagg

SEQ ID NO: 302051 - DNA, 2149 bp, Homo sapiens
gcgcctgcctcgcagagcttccgcttccggcccttcaggctctgtctctgtggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttggcctgctcaacatgaaggtgatgaggatgaagacctttatgatgatccacttccacttcatgaatagtaaatctatttttactgaataaagtaattatggaaaatattttaaactctagaagcttcaataatgatgtgtgattggatggaattgaatcaaactgaaaaagtatttcttatagcttaatggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaaggtgaagaaatttgagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaaaaaaaca

SEQ ID NO: 302052 - DNA, 972 bp, Homo sapiens
  misc_feature (789)..(789): n is a, c, g, or t
tcttatcttctcgtagcgtttctaaagtgtggtgagtagtgggactgccttcaaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaatagaggagaagacagtgggagagcaagagcagattgataagcataagagtgagtctgataatgagaatatgacagatatggatcaccctgagacctgggactggatacatggatgagactctagcacctattggtaaatacaggtttacaaacacctttaagatggatggactaaatagcaaggtaggctcgaagtctgataaggataacggggggggccttcatttatggtccatatgtcgaacatttgtcggtatttcatatttcctagtgtagatgccaatcctgaaggacaatcgaggtggtttgcttatacctataattacggttcaccgggctcaatcttgaattatggggatcatgtcagagttaattcgggcgctcaatataacagttttgtctagttagttataacacgaaaccgtgtgatcatgtagacagtccgtactgaaagcatgttgagctcaaatcgatgttgaggagccagaggtgaatgcagatggcacactccaccagantctcctagtaatatagcgactggagcgtatatcgtgagtctctaatgtagagtagatatgattgtgtttagctatacactctcttcattaactggagctgtaccacactagatggtgttatatatacaatgacatactcaccgaagatgcaggtcggtccagacagccgtggtggcgtgtgag

SEQ ID NO: 302053 - DNA, 1961 bp, Homo sapiens
gcgcctgcctcgcagagcttccgcttccggcccttcaggctctgtctctgtggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaaggtgaagaaatttgagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaaaaaaaca

SEQ ID NO: 302054 - DNA, 2074 bp, Homo sapiens
gcgcctgcctcgcagagcttccgcttccggcccttcaggctctgtctctgtggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacagcagtgtacttgtaaattgggtcttctcaaaactcactctaaccaaatggataaggttctgttaaggaagcacaggaaagcttttctgttccccttgacaactagttcttctaggtggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaaggtgaagaaatttgagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaaaaaaaca

SEQ ID NO: 302055 - DNA, 2163 bp, Homo sapiens
gcgcctgcctcgcagagcttccgcttccggcccttcaggctctgtctctgtggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacagcagtgtacttgtaaattgggtcttctcaaaactcactctaaccaaatggataaggttctgttaaggaagcacaggaaagcttttctgttccccttgacaactagttcttctaggtggcctgctgatagcatgtgctcattttggtgcatatgtgtatgggacagacatagactacaacacagttcatggcttggcctgctcaacatgaaggtgatgaggatgaagacctttatgatgatccacttccacttcatgaatagtaaatctatttttactgaataaagaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaaggtgaagaaatttgagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaaaaaaaca

SEQ ID NO: 302056 - DNA, 2109 bp, Homo sapiens
gcgcctgcctcgcagagcttccgcttccggcccttcaggctctgtctctgtggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacagcagtgtacttgtaaattgggtcttctcaaaactcactctaaccaaatggataaggttctgttaaggaagcacaggaaagcttttctgttccccttgacaactagttcttctaggtggcctgctgatagcatgtgctcattttggtgcatatgtgtatgggacagacatagactacaacacagttcatggcttggcctgctcaacatgaaggtgatgaggatgaagacctttatgatgatccacttccacttcatgaatagtaaatctatttttactgaataaagaaaggctactaggaaaaaccagaagtggagaggaccagatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaaggtgaagaaatttgagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaaaaaaaca

SEQ ID NO: 302057 - DNA, 2029 bp, Homo sapiens
gcgcctgcctcgcagagcttccgcttccggcccttcaggctctgtctctgtggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggtgagtccgtagcgccctccggaacttccgacggaagaggacgctggagtggagtggagtgggtggaggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaaggtgaagaaatttgagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaaaaaaaca

SEQ ID NO: 302058 - DNA, 2112 bp, Homo sapiens
gcgcctgcctcgcagagcttccgcttccggcccttcaggctctgtctctgtggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggtgagtccgtagcgccctccggaacttccgacggaagaggacgctggagtggagtggagtgggtggaggtgatctgcatagcccgaggaagctgggattcgggggtcttcgctggtctgcgcgggtcacgcgtccccagtcctcgggcggggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaaggtgaagaaatttgagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaaaaaaaca

SEQ ID NO: 302059 - DNA, 1999 bp, Homo sapiens
ttcgtctagcggagaatagagacagctaacaaatgctcaggctggtgtttgaagtattggaatctgcggatcaagctcagtggaggggatggtggtggggattagatgatggagaagttgagaagagtgttttatttattcaagaaacgttttcagaatgcatgtagtcgaagatcggtacgctgggcatgtaacgatgatgtaagcaatctctgccctctaggagcttactgtttagagtaagggctgagcagacacataggcgtagaatgacagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaaggtgaagaaatttgagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaaaaaaaca

SEQ ID NO: 302060 - DNA, 1233 bp, Homo sapiens
gcgcctgcctcgcagagcttccgcttccggcccttcaggctctgtctctgtggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctgaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaaaaaaaca

SEQ ID NO: 302061 - DNA, 174 bp, Homo sapiens
agatcggtacgctgggcatgtaacgatgatgtaagcaatctctgccctctaggagcttactgtttagagtaagggctgagcagacacataggcgtagaatgacaaaagagcgtcggtaagtgcagtgatagatgcacatggaaatatgagagcacgtggaagggaaatctaatc

SEQ ID NO: 302062 - DNA, 326 bp, Homo sapiens
gataagttagacatcagtacattttactgttatgttgaaattaaaataactatttacttgtatacataaaattaagattttaaatgaaagcaaattttgaataaatgtaggtttcagtgagttaaaacattacttttcctaaatgacagaaaataagaatactctgtttaatactttctctcttcctttttctttcccttcaggaaaggctactaggaaaaaccagaagtggagaggaccagatgaaaacattagggccaatcttcgtcaatatggtttagagaagtattaccttgatgtcctggtttcagatgcatctaaacctt

SEQ ID NO: 302063 - DNA, 5607 bp, Homo sapiens
attcagcctcttcggaccctctctcactccctgtcttccggagcgtgagtgaagcccgggtgaggtgttttcccacacgccgggggcccggagctgagaaggggcatggccagcatcacgcagctgttcgacgacctgtgtgaggccctcctgccggctgccaagactcacctgggccagcgcagtgtgaaccggaagagggcaaagcggagcctcaagaaggtggcctacaatgctcttttcacaaatctttttcaagatgagactcaacagctgcagcctgacatgtcaaaactaccagcgagaaacaagatcctcatgttgtcctttgacttgagagtgggtggcctgggccccaaggccgaccgtttggaggagcttgtggaggagctggaagcagccccttgctgtccgcttttggaggtggggtctgttttggacctcctggttcagctggcagggagtggtccccctcaagttctgccgagaaaacgagactacttccttaacaacaagcatgtggggagaaacgttccgtacagcggctatgattgcgacgacctgagtgtgtttgagatggacgttcagtctctgatctccagagaagagtgtttgtgtcacagcatgatccaggaaacacttcaggttatggaggctgctccaggcactggcctgcccaccgtcgggctcttctcatttggtgacccttgtggtgacaggttcgagagagacacccgggtctcgctcttcggggcccttgtgcacagccgcacttatgacatggacgtccgactgggcctgccccccgtgccagacaatgcggacctctctgggctggctattaaggtcccaccgagtgtggatcagtgggaagacgaaggattccagtcagcgtccaacttgactcctgattcccagtctgagcccagcgtgaccccagacgtggacctgtgggaagccgcacttacctatgaggccagcaagcggaggtgctgggagcgagttggctgcccccctggccacagagaggagccttacctgacggaggcgggaagggacgctttcgacaagttctgcaggctccaccaaggggagctccagctgcttgctgggggcgtcctacaggccccgcagcccgtgctggtgaaggagtgcgagctggtgaaagacgtgctgaacgtcttgattggggtcgtgtctgccacgttttcgctctgccagccggcccaggcctttgtggtgaagcggggcgtccacgtgtcaggagcgtctcccgagagcatcagcagcctgctctcggaagtggccgagtatgggacctgctacacgcgcctgagtcatttctctctgcagcccgtcctggactctttgtacagcaagggcctcgtgttccaggccttcaccagtggcctgaggaggtacctgcagtattaccgggcctgcgtcctttccactccgcccaccctgagcctcctcaccattggttttctcttcaagaaacttggccggcagctcaggtacctggccgagctctgtggcgttggcgctgtgctcccgggcacctgtggaggaggccccagggccgcgtttcccaccggcgtgaagctgctgtcctacctctaccaggaggctctgcacaactgcagcaacgagcactaccctgtactgctgtccctgctgaagaccagctgcgagccctacacccggttcatccacgactgggtgtacagcggggtgttcagagacgcttatggcgagttcatgattcaggtgaaccacgagtacctcagcttccgagataagtcgtactggacacatggctacgtgctcatctccaaagaggtggaggactgtgttcccgtgtttctgaagcacattgcccacgacatatacgtctgcggaaagaccattaacctgctgaagctctgctgcccccggcattacctctgttggtccgacgtccctgtcccccggatctcggtgattttctcccttgaggagttgaaggagattgagaaggactgtgccgtctacgttgggcgcatggagagggtggcccgccacagctctgtcagcaaggaggagaaggaattacgtatggaaattgcaaaacaagaattaatcgctcatgcccgggaagcagcatccagggtcctgagtgcactgagtgaccggcagatgtcagaacggatggccttggatgcccggaagcgtgagcagtttcagaggctgaaagaacaatttgtgaaggaccaggagcgacgccaggcggccaggcaggaggagctggatgatgacttcagctacgcccgtgaactccgagacagggagagaaggctgaagtccctggaggaggagctggagaggaaggcgaggcaggcactggtcgaccactacagcaagctctctgcagaggcagctcgtcgggagcagaaggcactgtggagaatccagaggcaccgactggagagtgcacggcttcgttttctcttagaagatgagaaacacattcaggagatgctgaaagcagtgtctgaggctcaccagccccaggagccgccagacgtcctcttgagcgtgcacccccaggtcacgtctccgggccctgagcacccagagggaggccaaggctgtgattctgggtctgcagagcaacactcgcctgcctgggatggctggaacaggccaggcctgctgaccccacagccccttaagcctctagcagtgggggctggtggcagggggctgcagcaggcggagggggccagacccttctctgacagcctcagcattggagacttcctacctgtgggcccaggggctgagccgtccgtgcagactggcatggtccctctcctggaggtggcgctgcagaccattaacttggacctgcccccctcagctcctggggaggcacccgcagcagccagcactcagccctccaggccacaggagtacgactttagtactgtcctgaggccagctgtggccacctcacctgcaccagggcccctgcaggctgcagagtgcagcttgggcagctcagggctacagctgtgggaggacagttgtgggaagatggatgcctgtggctccgcctcgcgggagactctgctcccctcacacccacccaggcgtgctgctctggaggaggggagcagccagcccacagagcggctctttgggcaggtgtcagggggtggtcttcccacaggggactacgcttctgaaatagctcccacccggccacggtggaacacccacgggcacgtgtctgacgccagcatcagggtcggggagaatgtgtcagatgtggctcccacccagccacggtggaacacccacggacacgtatccaatgccagcatcagcttaggggagtctgtgtcagatgtggctcccactcggccacggtggaacatccatggacatgtgtccaacgccagcatcagggtcggggagaatgtgtcagatgtggctcccaccaggccacggtggaatacccacgggcacgtgtccaacgccagcatcagggttggggagaacgtgtcggacgtggctcccacccggccacggtggaacacccatggacacgtgtccgatgccagcatcagcttgggggagtctgtgtcagacatggctcccgcccggccacggtggaacacccatggacacgtgtctgatgccagcatcagcttgggggagtctgtgtcagacatggctcccacccggccacggtggaacacccacggacatgtgtctgacaccagcatcagggttggggagaacgtatcggacgtggctcccatccggtcacggtgcaacacccatggacacgtgtccgacgccagcatcagcttgggggagcctgtgtcggatgtggtttccacccggccacggtggaacacccatgtacccatccctccgccccacatggtgctgggggctctctcaccagaagctgagcccaacacacccaggccccaacagagcccccctggccacacgtcccagtcagcgctcagcctgggagcacagagcactgtgctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggccctgggaggagcggggacgctgaggacctctctccaaattggcctctcaactcacaggaagacacagctgcccagagcagcccaggccgtggtgaggaggcggaggcatcggcggcggaggctcagggtggggagcaggcctacctggcaggcctggcagggcagtaccacttggagcggtacccggacagttacgagtccatgtccgagccgcccattgctcatcttttgcgccccgtgcttccccgggccttcgccttccccgtggacccccaggtccagtctgccgctgatgagactgctgtgcagctgagcgagttgctgacgctgcccgtgctcatgaagcgctccatcacggcaccgctggccgcccacatctccttggtgaacaaggccgctgtcgactacttcttcgtggagctgcacctggaggcgcactatgaggcactgcggcacttcctgctgatggaggacggcgagttcgcccagtccctcagcgacctgctctttgagaagcttggagctgggcaaacgcccggagagctgctcaacccgctggtgctgaactctgtgctgagcaaggccctgcagtgcagcctgcatggggacaccccgcacgcctccaacctctccctcgctctcaagtacctgcccgaggtgtttgcccccaacgccccggatgtgctgagctgcctggagctcaggtacaaggtggactggcctctcaacattgtcatcaccgagggctgcctgagcaagtacagcggcgtcttctccttcctgctgcagctgaagctcatgatgtgggcgctcaaggacgtctgcttccacctcaagcgcacagccctgctgagccacatggccggctctgtgcagttccgtcagctgcagctgttcaagcacgagatgcagcatttcgtgaaggtcatccagggctacatcgccaaccagatcctgcacgtcacctggtgcgagttcagggccaggttggccaccgtgggcgacctggaggagatccagcgtgcgcacgcagagtacctgcacaaggccgtcttcaggggcctgctcacggagaaggcggcgcccgtcatgaacgtcatccacagcatcttcagcctcgtgctcaagttccgcagccagctcatctcccaggcctgggggccccctgggggcccgcggggtgcagagcaccccaactttgcactcatgcagcagtcctacaacaccttcaagtactactcccactttctcttcaaagtggtgaccaagctggtgaaccgcggctaccagccccacctggaggactttctgctgcgcatcaacttcaacaactactaccaggacgcctgaggctgctctgcgggggacgtgcacaataaaggtgttctcgga

SEQ ID NO: 302064 - DNA, 5808 bp, Homo sapiens
attcagcctcttcggaccctctctcactccctgtcttccggagcgtgagtgaagcccgggtgaggtgttttcccacacgccgggggcccggagctgagaaggggcatggccagcatcacgcagctgttcgacgacctgtgtgaggccctcctgccggctgccaagactcacctgggccagcgcagtgtgaaccggaagagggcaaagcggagcctcaagaaggtggcctacaatgctcttttcacaaatctttttcaagatgagactcaacagctgcagcctgacatgtcaaaactaccagcgagaaacaagatcctcatgttgtcctttgacttgagagtgggtggcctgggccccaaggccgaccgtttggaggagcttgtggaggagctggaagcagccccttgctgtccgcttttggaggtggggtctgttttggacctcctggttcagctggcagggagtggtccccctcaagttctgccgagaaaacgagactacttccttaacaacaagcatgtggggagaaacgttccgtacagcggctatgattgcgacgacctgagtgtgtttgagatggacgttcagtctctgatctccagagaagagtgtttgtgtcacagcatgatccaggaaacacttcaggttatggaggctgctccaggcactggcctgcccaccgtcgggctcttctcatttggtgacccttgtggtgacaggttcgagagagacacccgggtctcgctcttcggggcccttgtgcacagccgcacttatgacatggacgtccgactgggcctgccccccgtgccagacaatgcggacctctctgggctggctattaaggtcccaccgagtgtggatcagtgggaagacgaaggattccagtcagcgtccaacttgactcctgattcccagtctgagcccagcgtgaccccagacgtggacctgtgggaagccgcacttacctatgaggccagcaagcggaggtgctgggagcgagttggctgcccccctggccacagagaggagccttacctgacggaggcgggaagggacgctttcgacaagttctgcaggctccaccaaggggagctccagctgcttgctgggggcgtcctacaggccccgcagcccgtgctggtgaaggagtgcgagctggtgaaagacgtgctgaacgtcttgattggggtcgtgtctgccacgttttcgctctgccagccggcccaggcctttgtggtgaagcggggcgtccacgtgtcaggagcgtctcccgagagcatcagcagcctgctctcggaagtggccgagtatgggacctgctacacgcgcctgagtcatttctctctgcagcccgtcctggactctttgtacagcaagggcctcgtgttccaggccttcaccagtggcctgaggaggtacctgcagtattaccgggcctgcgtcctttccactccgcccaccctgagcctcctcaccattggttttctcttcaagaaacttggccggcagctcaggtacctggccgagctctgtggcgttggcgctgtgctcccgggcacctgtggaggaggccccagggccgcgtttcccaccggcgtgaagctgctgtcctacctctaccaggaggctctgcacaactgcagcaacgagcactaccctgtactgctgtccctgctgaagaccagctgcgagccctacacccggttcatccacgactgggtgtacagcggggtgttcagagacgcttatggcgagttcatgattcaggtgaaccacgagtacctcagcttccgagataagtcgtactggacacatggctacgtgctcatctccaaagaggtggaggactgtgttcccgtgtttctgaagcacattgcccacgacatatacgtctgcggaaagaccattaacctgctgaagctctgctgcccccggcattacctctgttggtccgacgtccctgtcccccggatctcggtgattttctcccttgaggagttgaaggagattgagaaggactgtgccgtctacgttgggcgcatggagagggtggcccgccacagctctgtcagcaaggaggagaaggaattacgtatggaaattgcaaaacaagaattaatcgctcatgcccgggaagcagcatccagggtcctgagtgcactgagtgaccggcagatgtcagaacggatggccttggatgcccggaagcgtgagcagtttcagaggctgaaagaacaatttgtgaaggaccaggagcgacgccaggcggccaggcaggaggagctggatgatgacttcagctacgcccgtgaactccgagacagggagagaaggctgaagtccctggaggaggagctggagaggaaggcgaggcaggcactggtcgaccactacagcaagctctctgcagaggcagctcgtcgggagcagaaggcactgtggagaatccagaggcaccgactggagagtgcacggcttcgttttctcttagaagatgagaaacacattcaggagatgctgaaagcagtgtctgaggctcaccagccccaggagccgccagacgtcctcttgagcgtgcacccccaggtcacgtctccgggccctgagcacccagagggaggccaaggctgtgattctgggtctgcagagcaacactcgcctgcctgggatggctggaacaggccaggcctgctgaccccacagccccttaagcctctagcagtgggggctggtggcagggggctgcagcaggcggagggggccagacccttctctgacagcctcagcattggagacttcctacctgtgggcccaggggctgagccgtccgtgcagactggcatggtccctctcctggaggtggcgctgcagaccattaacttggacctgcccccctcagctcctggggaggcacccgcagcagccagcactcagccctccaggccacaggagtacgactttagtactgtcctgaggccagctgtggccacctcacctgcaccagggcccctgcaggctgcagagtgcagcttgggcagctcagggctacagctgtgggaggacagttgtgggaagatggatgcctgtggctccgcctcgcgggagactctgctcccctcacacccacccaggcgtgctgctctggaggaggggagcagccagcccacagagcggctctttgggcaggtgtcagggggtggtcttcccacaggggactacgcttctgaaatagctcccacccggccacggtggaacacccacgggcacgtgtctgacgccagcatcagggtcggggagaatgtgtcagatgtggctcccacccagccacggtggaacacccacggacacgtatccaatgccagcatcagcttaggggagtctgtgtcagatgtggctcccactcggccacggtggaacatccatggacatgtgtccaacgccagcatcagggtcggggagaatgtgtcagatgtggctcccaccaggccacggtggaatacccacgggcacgtgtccaacgccagcatcagggttggggagaacgtgtcggacgtggctcccacccggccacggtggaacacccatggacacgtgtccgatgccagcatcagcttgggggagtctgtgtcagacatggctcccgcccggccacggtggaacacccatggacacgtgtctgatgccagcatcagcttgggggagtctgtgtcagacatggctcccacccggccacggtggaacacccacggacatgtgtctgacaccagcatcagggttggggagaacgtatcggacgtggctcccatccggtcacggtgcaacacccatggacacgtgtccgacgccagcatcagcttgggggagcctgtgtcggatgtggtttccacccggccacggtggaacacccatgtacccatccctccgccccacatggtgctgggggctctctcaccagaagctgagcccaacacacccaggccccaacagagcccccctggccacacgtcccagtcagcgctcagcctgggagcacagagcactgtgctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggtcagagtagggtggctggtggtcaggagtgggactgtgggacgcacagagcctgggaggtaggcgggcagtggggttggtggcatgtgaagttcccctcaggcctcctcgtcagccaggacctgggctgctgtgggggacatgggaggggctgcttgagccagggccggctcggctccgtacccgccacaggcactcggccctgatgccctcgtgtccacttgtgtccacacaggccctgggaggagcggggacgctgaggacctctctccaaattggcctctcaactcacaggaagacacagctgcccagagcagcccaggccgtggtgaggaggcggaggcatcggcggcggaggctcagggtggggagcaggcctacctggcaggcctggcagggcagtaccacttggagcggtacccggacagttacgagtccatgtccgagccgcccattgctcatcttttgcgccccgtgcttccccgggccttcgccttccccgtggacccccaggtccagtctgccgctgatgagactgctgtgcagctgagcgagttgctgacgctgcccgtgctcatgaagcgctccatcacggcaccgctggccgcccacatctccttggtgaacaaggccgctgtcgactacttcttcgtggagctgcacctggaggcgcactatgaggcactgcggcacttcctgctgatggaggacggcgagttcgcccagtccctcagcgacctgctctttgagaagcttggagctgggcaaacgcccggagagctgctcaacccgctggtgctgaactctgtgctgagcaaggccctgcagtgcagcctgcatggggacaccccgcacgcctccaacctctccctcgctctcaagtacctgcccgaggtgtttgcccccaacgccccggatgtgctgagctgcctggagctcaggtacaaggtggactggcctctcaacattgtcatcaccgagggctgcctgagcaagtacagcggcgtcttctccttcctgctgcagctgaagctcatgatgtgggcgctcaaggacgtctgcttccacctcaagcgcacagccctgctgagccacatggccggctctgtgcagttccgtcagctgcagctgttcaagcacgagatgcagcatttcgtgaaggtcatccagggctacatcgccaaccagatcctgcacgtcacctggtgcgagttcagggccaggttggccaccgtgggcgacctggaggagatccagcgtgcgcacgcagagtacctgcacaaggccgtcttcaggtgaggcctgggcagcggctgcgtccctgtggtcacggctcagcccacccagcagcactgcttccccccacccctgggggcccgcggggtgcagagcaccccaactttgcactcatgcagcagtcctacaacaccttcaagtactactcccactttctcttcaaagtggtgaccaagctggtgaaccgcggctaccagccccacctggaggactttctgctgcgcatcaacttcaacaactactaccaggacgcctgaggctgctctgcgggggacgtgcacaataaaggtgttctcgga

SEQ ID NO: 302065 - DNA, 4066 bp, Homo sapiens
  misc_feature (5)..(5): n is a, c, g, or t
  misc_feature (7)..(10): n is a, c, g, or t
  misc_feature (14)..(14): n is a, c, g, or t
  misc_feature (17)..(17): n is a, c, g, or t
  misc_feature (20)..(20): n is a, c, g, or t
cacgngnnnntcanctnccnagataagtcgtactggacacatggctacgtgctcatctccaaagaggtggaggactgtgttcccgtgtttctgaagcacattgcccacgacatatacgtctgcggaaagaccattaacctgctgaagctctgctgcccccggcattacctctgttggtccgacgtccctgtcccccggatctcggtgattttctcccttgaggagttgaaggagattgagaaggactgtgccgtctacgttgggcgcatggagagggtggcccgccacagctctgtcagcaaggaggagaaggaattacgtatggaaattgcaaaacaagaattaatcgctcatgcccgggaagcagcatccagggtcctgagtgcactgagtgaccggcagatgtcagaacggatggccttggatgcccggaagcgtgagcagtttcagaggctgaaagaacaatttgtgaaggaccaggagcgacgccaggcggccaggcaggaggagctggatgatgacttcagctacgcccgtgaactccgagacagggagagaaggctgaagtccctggaggaggagctggagaggaaggcgaggcaggcactggtcgaccactacagcaagctctctgcagaggcagctcgtcgggagcagaaggcactgtggagaatccagaggcaccgactggagagtgcacggcttcgttttctcttagaagatgagaaacacattcaggagatgctgaaagcagtgtctgaggctcaccagccccaggagccgccagacgtcctcttgagcgtgcacccccaggtcacgtctccgggccctgagcacccagagggaggccaaggctgtgattctgggtctgcagagcaacactcgcctgcctgggatggctggaacaggccaggcctgctgaccccacagccccttaagcctctagcagtgggggctggtggcagggggctgcagcaggcggagggggccagacccttctctgacagcctcagcattggagacttcctacctgtgggcccaggggctgagccgtccgtgcagactggcatggtccctctcctggaggtggcgctgcagaccattaacttggacctgcccccctcagctcctggggaggcacccgcagcagccagcactcagccctccaggccacaggagtacgactttagtactgtcctgaggccagctgtggccacctcacctgcaccagggcccctgcaggctgcagagtgcagcttgggcagctcagggctacagctgtgggaggacagttgtgggaagatggatgcctgtggctccgcctcgcgggagactctgctcccctcacacccacccaggcgtgctgctctggaggaggggagcagccagcccacagagcggctctttgggcaggtgtcagggggtggtcttcccacaggggactacgcttctgaaatagctcccacccggccacggtggaacacccacgggcacgtgtctgacgccagcatcagggtcggggagaatgtgtcagatgtggctcccacccagccacggtggaacacccacggacacgtatccaatgccagcatcagcttaggggagtctgtgtcagatgtggctcccactcggccacggtggaacatccatggacatgtgtccaacgccagcatcagggtcggggagaatgtgtcagatgtggctcccaccaggccacggtggaatacccacgggcacgtgtccaacgccagcatcagggttggggagaacgtgtcggacgtggctcccacccggccacggtggaacacccatggacacgtgtccgatgccagcatcagcttgggggagtctgtgtcagacatggctcccgcccggccacggtggaacacccatggacacgtgtctgatgccagcatcagcttgggggagtctgtgtcagacatggctcccacccggccacggtggaacacccacggacatgtgtctgacaccagcatcagggttggggagaacgtatcggacgtggctcccatccggtcacggtgcaacacccatggacacgtgtccgacgccagcatcagcttgggggagcctgtgtcggatgtggtttccacccggccacggtggaacacccatgtacccatccctccgccccacatggtgctgggggctctctcaccagaagctgagcccaacacacccaggccccaacagagcccccctggccacacgtcccagtcagcgctcagcctgggagcacagagcactgtgctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggtcagagtagggtggctggtggtcaggagtgggactgtgggacgcacagagcctgggaggtaggcgggcagtggggttggtggcatgtgaagttcccctcaggcctcctcgtcagccaggacctgggctgctgtgggggacatgggaggggctgcttgagccagggccggctcggctccgtacccgccacaggcactcggccctgatgccctcgtgtccacttgtgtccacacaggccctgggaggagcggggacgctgaggacctctctccaaattggcctctcaactcacaggaagacacagctgcccagagcagcccaggccgtggtgaggaggcggaggcatcggcggcggaggctcagggtggggagcaggcctacctggcaggcctggcagggcagtaccacttggagcggtacccggacagttacgagtccatgtccgagccgcccattgctcatcttttgcgccccgtgcttccccgggccttcgccttccccgtggacccccaggtccagtctgccgctgatgagactgctgtgcagctgagcgagttgctgacgctgcccgtgctcatgaagcgctccatcacggcaccgctggccgcccacatctccttggtgaacaaggccgctgtcgactacttcttcgtggagctgcacctggaggcgcactatgaggcactgcggcacttcctgctgatggaggacggcgagttcgcccagtccctcagcgacctgctctttgagaagcttggagctgggcaaacgcccggagagctgctcaacccgctggtgctgaactctgtgctgagcaaggccctgcagtgcagcctgcatggggacaccccgcacgcctccaacctctccctcgctctcaagtacctgcccgaggtgtttgcccccaacgccccggatgtgctgagctgcctggagctcaggtacaaggtggactggcctctcaacattgtcatcaccgagggctgcctgagcaagtacagcggcgtcttctccttcctgctgcagctgaagctcatgatgtgggcgctcaaggacgtctgcttccacctcaagcgcacagccctgctgagccacatggccggctctgtgcagttccgtcagctgcagctgttcaagcacgagatgcagcatttcgtgaaggtcatccagggctacatcgccaaccagatcctgcacgtcacctggtgcgagttcagggccaggttggccaccgtgggcgacctggaggagatccagcgtgcgcacgcagagtacctgcacaaggccgtcttcaggggcctgctcacggagaaggcggcgcccgtcatgaacgtcatccacagcatcttcagcctcgtgctcaagttccgcagccagctcatctcccaggcctgggggccccctgggggcccgcggggtgcagagcaccccaactttgcactcatgcagcagtcctacaacaccttcaagtactactcccactttctcttcaaagtggtgaccaagctggtgaaccgcggctaccagccccacctggaggactttctgctgcgcatcaacttcaacaactactaccaggacgcctgaggctgctctgcgggggacgtgcacaataaaggtgttctcgga

SEQ ID NO: 302066 - DNA, 5891 bp, Homo sapiens
attcagcctcttcggaccctctctcactccctgtcttccggagcgtgagtgaagcccgggtgaggtgttttcccacacgccgggggcccggagctgagaaggggcatggccagcatcacgcagctgttcgacgacctgtgtgaggccctcctgccggctgccaagactcacctgggccagcgcagtgtgaaccggaagagggcaaagcggagcctcaagaaggtggcctacaatgctcttttcacaaatctttttcaagatgagactcaacagctgcagcctgacatgtcaaaactaccagcgagaaacaagatcctcatgttgtcctttgacttgagagtgggtggcctgggccccaaggccgaccgtttggaggagcttgtggaggagctggaagcagccccttgctgtccgcttttggaggtggggtctgttttggacctcctggttcagctggcagggagtggtccccctcaagttctgccgagaaaacgagactacttccttaacaacaagcatgtggggagaaacgttccgtacagcggctatgattgcgacgacctgagtgtgtttgagatggacgttcagtctctgatctccagagaagagtgtttgtgtcacagcatgatccaggaaacacttcaggttatggaggctgctccaggcactggcctgcccaccgtcgggctcttctcatttggtgacccttgtggtgacaggttcgagagagacacccgggtctcgctcttcggggcccttgtgcacagccgcacttatgacatggacgtccgactgggcctgccccccgtgccagacaatgcggacctctctgggctggctattaaggtcccaccgagtgtggatcagtgggaagacgaaggattccagtcagcgtccaacttgactcctgattcccagtctgagcccagcgtgaccccagacgtggacctgtgggaagccgcacttacctatgaggccagcaagcggagcccccctggccacagagaggagccttacctgacggaggcgggaagggacgctttcgacaagttctgcaggctccaccaaggggagctccagctgcttgctgggggcgtcctacaggccccgcagcccgtgctggtgaaggagtgcgagctggtgaaagacgtgctgaacgtcttgattggggtcgtgtctgccacgttttcgctctgccagccggcccaggcctttgtggtgaagcggggcgtccacgtgtcaggagcgtctcccgagagcatcagcagcctgctctcggaagtggccgagtatgggacctgctacacgcgcctgagtcatttctctctgcagcccgtcctggactctttgtacagcaagggcctcgtgttccaggccttcaccagtggcctgaggaggtacctgcagtattaccgggcctgcgtcctttccactccgcccaccctgagcctcctcaccattggttttctcttcaagaaacttggccggcagctcaggtacctggccgagctctgtggcgttggcgctgtgctcccgggcacctgtggaggaggccccagggccgcgtttcccaccggcgtgaagctgctgtcctacctctaccaggaggctctgcacaactgcagcaacgagcactaccctgtactgctgtccctgctgaagaccagctgcgagccctacacccggttcatccacgactgggtgtacagcggggtgttcagagacgcttatggcgagttcatgattcaggtgaaccacgagtacctcagcttccgagataagtcgtactggacacatggctacgtgctcatctccaaagaggtggaggactgtgttcccgtgtttctgaagcacattgcccacgacatatacgtctgcggaaagaccattaacctgctgaagctctgctgcccccggcattacctctgttggtccgacgtccctgtcccccggatctcggtgattttctcccttgaggagttgaaggagattgagaaggactgtgccgtctacgttgggcgcatggagagggtggcccgccacagctctgtcagcaaggaggagaaggaattacgtatggaaattgcaaaacaagaattaatcgctcatgcccgggaagcagcatccagggtcctgagtgcactgagtgaccggcagatgtcagaacggatggccttggatgcccggaagcgtgagcagtttcagaggctgaaagaacaatttgtgaaggaccaggagcgacgccaggcggccaggcaggaggagctggatgatgacttcagctacgcccgtgaactccgagacagggagagaaggctgaagtccctggaggaggagctggagaggaaggcgaggcaggcactggtcgaccactacagcaagctctctgcagaggcagctcgtcgggagcagaaggcactgtggagaatccagaggcaccgactggagagtgcacggcttcgttttctcttagaagatgagaaacacattcaggagatgctgaaagcagtgtctgaggctcaccagccccaggagccgccagacgtcctcttgagcgtgcacccccaggtcacgtctccgggccctgagcacccagagggaggccaaggctgtgattctgggtctgcagagcaacactcgcctgcctgggatggctggaacaggccaggcctgctgaccccacagccccttaagcctctagcagtgggggctggtggcagggggctgcagcaggcggagggggccagacccttctctgacagcctcagcattggagacttcctacctgtgggcccaggggctgagccgtccgtgcagactggcatggtccctctcctggaggtggcgctgcagaccattaacttggacctgcccccctcagctcctggggaggcacccgcagcagccagcactcagccctccaggccacaggagtacgactttagtactgtcctgaggccagctgtggccacctcacctgcaccagggcccctgcaggctgcagagtgcagcttgggcagctcagggctacagctgtgggaggacagttgtgggaagatggatgcctgtggctccgcctcgcgggagactctgctcccctcacacccacccaggcgtgctgctctggaggaggggagcagccagcccacagagcggctctttgggcaggtgtcagggggtggtcttcccacaggggactacgcttctgaaatagctcccacccggccacggtggaacacccacgggcacgtgtctgacgccagcatcagggtcggggagaatgtgtcagatgtggctcccacccagccacggtggaacacccacggacacgtatccaatgccagcatcagcttaggggagtctgtgtcagatgtggctcccactcggccacggtggaacatccatggacatgtgtccaacgccagcatcagggtcggggagaatgtgtcagatgtggctcccaccaggccacggtggaatacccacgggcacgtgtccaacgccagcatcagggttggggagaacgtgtcggacgtggctcccacccggccacggtggaacacccatggacacgtgtccgatgccagcatcagcttgggggagtctgtgtcagacatggctcccgcccggccacggtggaacacccatggacacgtgtctgatgccagcatcagcttgggggagtctgtgtcagacatggctcccacccggccacggtggaacacccacggacatgtgtctgacaccagcatcagggttggggagaacgtatcggacgtggctcccatccggtcacggtgcaacacccatggacacgtgtccgacgccagcatcagcttgggggagcctgtgtcggatgtggtttccacccggccacggtggaacacccatgtacccatccctccgccccacatggtgctgggggctctctcaccagaagctgagcccaacacacccaggccccaacagagcccccctggccacacgtcccagtcagcgctcagcctgggagcacagagcactgtgctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggtcagagtagggtggctggtggtcaggagtgggactgtgggacgcacagagcctgggaggtaggcgggcagtggggttggtggcatgtgaagttcccctcaggcctcctcgtcagccaggacctgggctgctgtgggggacatgggaggggctgcttgagccagggccggctcggctccgtacccgccacaggcactcggccctgatgccctcgtgtccacttgtgtccacacaggccctgggaggagcggggacgctgaggacctctctccaaattggcctctcaactcacaggaagacacagctgcccagagcagcccaggccgtggtgaggaggcggaggcatcggcggcggaggctcagggtggggagcaggcctacctggcaggcctggcagggcagtaccacttggagcggtacccggacagttacgagtccatgtccgagccgcccattgctcatcttttgcgccccgtgcttccccgggccttcgccttccccgtggacccccaggtccagtctgccgctgatgagactgctgtgcagctgagcgagttgctgacgctgcccgtgctcatgaagcgctccatcacggcaccgctggccgcccacatctccttggtgaacaaggccgctgtcgactacttcttcgtggagctgcacctggaggcgcactatgaggcactgcggcacttcctgctgatggaggacggcgagttcgcccagtccctcagcgacctgctctttgagaagcttggagctgggcaaacgcccggagagctgctcaacccgctggtgctgaactctgtgctgagcaaggccctgcagtgcagcctgcatggggacaccccgcacgcctccaacctctccctcgctctcaagtacctgcccgaggtgtttgcccccaacgccccggatgtgctgagctgcctggagctcaggtacaaggtggactggcctctcaacattgtcatcaccgagggctgcctgagcaagtacagcggcgtcttctccttcctgctgcagctgaagctcatgatgtgggcgctcaaggacgtctgcttccacctcaagcgcacagccctgctgagccacatggccggctctgtgcagttccgtcagctgcagctgttcaagcacgagatgcagcatttcgtgaaggtcatccagggctacatcgccaaccagatcctgcacgtcacctggtgcgagttcagggccaggttggccaccgtgggcgacctggaggagatccagcgtgcgcacgcagagtacctgcacaaggccgtcttcaggtgaggcctgggcagcggctgcgtccctgtggtcacggctcagcccacccagcagcactgcttccccccagggcctgctcacggagaaggcggcgcccgtcatgaacgtcatccacagcatcttcagcctcgtgctcaagttccgcagccagctcatctcccaggcctgggggccccctgggggcccgcggggtgcagagcaccccaactttgcactcatgcagcagtcctacaacaccttcaagtactactcccactttctcttcaaagtggtgaccaagctggtgaaccgcggctaccagccccacctggaggactttctgctgcgcatcaacttcaacaactactaccaggacgcctgaggctgctctgcgggggacgtgcacaataaaggtgttctcgga

SEQ ID NO: 302067 - DNA, 5899 bp, Homo sapiens
attcagcctcttcggaccctctctcactccctgtcttccggagcgtgagtgaagcccgggtgaggtgttttcccacacgccgggggcccggagctgagaaggggcatggccagcatcacgcagctgttcgacgacctgtgtgaggccctcctgccggctgccaagactcacctgggccagcgcagtgtgaaccggaagagggcaaagcggagcctcaagaaggtggcctacaatgctcttttcacaaatctttttcaagatgagactcaacagctgcagcctgacatgtcaaaactaccagcgagaaacaagatcctcatgttgtcctttgacttgagagtgggtggcctgggccccaaggccgaccgtttggaggagcttgtggaggagctggaagcagccccttgctgtccgcttttggaggtggggtctgttttggacctcctggttcagctggcagggagtggtccccctcaagttctgccgagaaaacgagactacttccttaacaacaagcatgtggggagaaacgttccgtacagcggctatgattgcgacgacctgagtgtgtttgagatggacgttcagtctctgatctccagagaagagtgtttgtgtcacagcatgatccaggaaacacttcaggttatggaggctgctccaggcactggcctgcccaccgtcgggctcttctcatttggtgacccttgtggtgacaggttcgagagagacacccgggtctcgctcttcggggcccttgtgcacagccgcacttatgacatggacgtccgactgggcctgccccccgtgccagacaatgcggacctctctgggctggctattaaggtcccaccgagtgtggatcagtgggaagacgaaggattccagtcagcgtccaacttgactcctgattcccagtctgagcccagcgtgaccccagacgtggacctgtgggaagccgcacttacctatgaggccagcaagcggagcccccctggccacagagaggagccttacctgacggaggcgggaagggacgctttcgacaagttctgcaggctccaccaaggggagctccagctgcttgctgggggcgtcctacaggccccgcagcccgtgctggtgaaggagtgcgagctggtgaaagacgtgctgaacgtcttgattggggtcgtgtctgccacgttttcgctctgccagccggcccaggcctttgtggtgaagcggggcgtccacgtgtcaggagcgtctcccgagagcatcagcagcctgctctcggaagtggccgagtatgggacctgctacacgcgcctgagtcatttctctctgcagcccgtcctggactctttgtacagcaagggcctcgtgttccaggccttcaccagtggcctgaggaggtacctgcagtattaccgggcctgcgtcctttccactccgcccaccctgagcctcctcaccattggttttctcttcaagaaacttggccggcagctcaggtacctggccgagctctgtggcgttggcgctgtgctcccgggcacctgtggaggaggccccagggccgcgtttcccaccggcgtgaagctgctgtcctacctctaccaggaggctctgcacaactgcagcaacgagcactaccctgtactgctgtccctgctgaagaccagctgcgagccctacacccggttcatccacgactgggtgtacagcggggtgttcagagacgcttatggcgagttcatgattcaggtgaaccacgagtacctcagcttccgagataagtcgtactggacacatggctacgtgctcatctccaaagaggtggaggactgtgttcccgtgtttctgaagcacattgcccacgacatatacgtctgcggaaagaccattaacctgctgaagctctgctgcccccggcattacctctgttggtccgacgtccctgtcccccggatctcggtgattttctcccttgaggagttgaaggagattgagaaggactgtgccgtctacgttgggcgcatggagagggtggcccgccacagctctgtcagcaaggaggagaaggaattacgtatggaaattgcaaaacaagaattaatcgctcatgcccgggaagcagcatccagggtcctgagtgcactgagtgaccggcagatgtcagaacggatggccttggatgcccggaagcgtgagcagtttcagaggctgaaagaacaatttgtgaaggaccaggagcgacgccaggcggccaggcaggaggagctggatgatgacttcagctacgcccgtgaactccgagacagggagagaaggctgaagtccctggaggaggagctggagaggaaggcgaggcaggcactggtcgaccactacagcaagctctctgcagaggcagctcgtcgggagcagaaggcactgtggagaatccagaggcaccgactggagagtgcacggcttcgttttctcttagaagatgagaaacacattcaggagatgctgaaagcagtgtctgaggctcaccagccccaggagccgccagacgtcctcttgagcgtgcacccccaggtcacgtctccgggccctgagcacccagagggaggccaaggctgtgattctgggtctgcagagcaacactcgcctgcctgggatggctggaacaggccaggcctgctgaccccacagccccttaagcctctagcagtgggggctggtggcagggggctgcagcaggcggagggggccagacccttctctgacagcctcagcattggagacttcctacctgtgggcccaggggctgagccgtccgtgcagactggcatggtccctctcctggaggtggcgctgcagaccattaacttggacctgcccccctcagctcctggggaggcacccgcagcagccagcactcagccctccaggccacaggagtacgactttagtactgtcctgaggccagctgtggccacctcacctgcaccagggcccctgcaggctgcagagtgcagcttgggcagctcagggctacagctgtgggaggacagttgtgggaagatggatgcctgtggctccgcctcgcgggagactctgctcccctcacacccacccaggcgtgctgctctggaggaggggagcagccagcccacagagcggctctttgggcaggtgtcagggggtggtcttcccacaggggactacgcttctgaaatagctcccacccggccacggtggaacacccacgggcacgtgtctgacgccagcatcagggtcggggagaatgtgtcagatgtggctcccacccagccacggtggaacacccacggacacgtatccaatgccagcatcagcttaggggagtctgtgtcagatgtggctcccactcggccacggtggaacatccatggacatgtgtccaacgccagcatcagggtcggggagaatgtgtcagatgtggctcccaccaggccacggtggaatacccacgggcacgtgtccaacgccagcatcagggttggggagaacgtgtcggacgtggctcccacccggccacggtggaacacccatggacacgtgtccgatgccagcatcagcttgggggagtctgtgtcagacatggctcccgcccggccacggtggaacacccatggacacgtgtctgatgccagcatcagcttgggggagtctgtgtcagacatggctcccacccggccacggtggaacacccacggacatgtgtctgacaccagcatcagggttggggagaacgtatcggacgtggctcccatccggtcacggtgcaacacccatggacacgtgtccgacgccagcatcagcttgggggagcctgtgtcggatgtggtttccacccggccacggtggaacacccatgtacccatccctccgccccacatggtgctgggggctctctcaccagaagctgagcccaacacacccaggccccaacagagcccccctggccacacgtcccagtcagcgctcagcctgggagcacagagcactgtgctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggtcagagtagggtggctggtggtcaggagtgggactgtgggacgcacagagcctgggaggtaggcgggcagtggggttggtggcatgtgaagttcccctcaggcctcctcgtcagccaggacctgggctgctgtgggggacatgggaggggctgcttgagccagggccggctcggctccgtacccgccacaggcactcggccctgatgccctcgtgtccacttgtgtccacacaggccctgggaggagcggggacgctgaggacctctctccaaattggcctctcaactcacaggaagacacagctgcccagagcagcccaggccgtggtgaggaggcggaggcatcggcggcggaggctcagggtggggagcaggcctacctggcaggcctggcagggcagtaccacttggagcggtacccggacagttacgagtccatgtccgagccgcccattgctcatcttttgcgccccgtgcttccccgggccttcgccttccccgtggacccccaggtccagtctgccgctgatgagactgctgtgcagctgagcgagttgctgacgctgcccgtgctcatgaagcgctccatcacggcaccgctggccgcccagtgagtgcccctgcccctgcgccagtctgcccacccagcccgtcctggcccgccctgactccagctccctcctgccagcatctccttggtgaacaaggccgctgtcgactacttcttcgtggagctgcacctggaggcgcactatgaggcactgcggcacttcctgctgatggaggacggcgagttcgcccagtccctcagcgacctgctctttgagaagcttggagctgggcaaacgcccggagagctgctcaacccgctggtgctgaactctgtgctgagcaaggccctgcagtgcagcctgcatggggacaccccgcacgcctccaacctctccctcgctctcaagtacctgcccgaggtgtttgcccccaacgccccggatgtgctgagctgcctggagctcaggtacaaggtggactggcctctcaacattgtcatcaccgagggctgcctgagcaagtacagcggcgtcttctccttcctgctgcagctgaagctcatgatgtgggcgctcaaggacgtctgcttccacctcaagcgcacagccctgctgagccacatggccggctctgtgcagttccgtcagctgcagctgttcaagcacgagatgcagcatttcgtgaaggtcatccagggctacatcgccaaccagatcctgcacgtcacctggtgcgagttcagggccaggttggccaccgtgggcgacctggaggagatccagcgtgcgcacgcagagtacctgcacaaggccgtcttcaggggcctgctcacggagaaggcggcgcccgtcatgaacgtcatccacagcatcttcagcctcgtgctcaagttccgcagccagctcatctcccaggcctgggggccccctgggggcccgcggggtgcagagcaccccaactttgcactcatgcagcagtcctacaacaccttcaagtactactcccactttctcttcaaagtggtgaccaagctggtgaaccgcggctaccagccccacctggaggactttctgctgcgcatcaacttcaacaactactaccaggacgcctgaggctgctctgcgggggacgtgcacaataaaggtgttctcgga

SEQ ID NO: 302068 - DNA, 3508 bp, Homo sapiens
  misc_feature (3055)..(3055): n is a, c, g, or t
attcagcctcttcggaccctctctcactccctgtcttccggagcgtgagtgaagcccgggtgaggtgttttcccacacgccgggggcccggagctgagaaggggcatggccagcatcacgcagctgttcgacgacctgtgtgaggccctcctgccggctgccaagactcacctgggccagcgcagtgtgaaccggaagagggcaaagcggagcctcaagaaggtggcctacaatgctcttttcacaaatctttttcaagatgagactcaacagctgcagcctgacatgtcaaaactaccagcgagaaacaagatcctcatgttgtcctttgacttgagagtgggtggcctgggccccaaggccgaccgtttggaggagcttgtggaggagctggaagcagccccttgctgtccgcttttggaggtggggtctgttttggacctcctggttcagctggcagggagtggtccccctcaagttctgccgagaaaacgagactacttccttaacaacaagcatgtggggagaaacgttccgtacagcggctatgattgcgacgacctgagtgtgtttgagatggacgttcagtctctgatctccagagaagagtgtttgtgtcacagcatgatccaggaaacacttcaggttatggaggctgctccaggcactggcctgcccaccgtcgggctcttctcatttggtgacccttgtggtgacaggttcgagagagacacccgggtctcgctcttcggggcccttgtgcacagccgcacttatgacatggacgtccgactgggcctgccccccgtgccagacaatgcggacctctctgggctggctattaaggtcccaccgagtgtggatcagtgggaagacgaaggattccagtcagcgtccaacttgactcctgattcccagtctgagcccagcgtgaccccagacgtggacctgtgggaagccgcacttacctatgaggccagcaagcggagcccccctggccacagagaggagccttacctgacggaggcgggaagggacgctttcgacaagttctgcaggctccaccaaggggagctccagctgcttgctgggggcgtcctacaggccccgcagcccgtgctggtgaaggagtgcgagctggtgaaagacgtgctgaacgtcttgattggggtcgtgtctgccacgttttcgctctgccagccggcccaggcctttgtggtgaagcggggcgtccacgtgtcaggagcgtctcccgagagcatcagcagcctgctctcggaagtggccgagtatgggacctgctacacgcgcctgagtcatttctctctgcagcccgtcctggactctttgtacagcaagggcctcgtgttccaggccttcaccagtggcctgaggaggtacctgcagtattaccgggcctgcgtcctttccactccgcccaccctgagcctcctcaccattggttttctcttcaagaaacttggccggcagctcaggtacctggccgagctctgtggcgttggcgctgtgctcccgggcacctgtggaggaggccccagggccgcgtttcccaccggcgtgaagctgctgtcctacctctaccaggaggctctgcacaactgcagcaacgagcactaccctgtactgctgtccctgctgaagaccagctgcgagccctacacccggttcatccacgactgggtgtacagcggggtgttcagagacgcttatggcgagttcatgattcaggtgaaccacgagtacctcagcttccgagataagtcgtactggacacatggctacgtgctcatctccaaagaggtggaggactgtgttcccgtgtttctgaagcacattgcccacgacatatacgtctgcggaaagaccattaacctgctgaagctctgctgcccccggcattacctctgttggtccgacgtccctgtcccccggatctcggtgattttctcccttgaggagttgaaggagattgagaaggactgtgccgtctacgttgggcgcatggagagggtggcccgccacagctctgtcagcaaggaggagaaggaattacgtatggaaattgcaaaacaagaattaatcgctcatgcccgggaagcagcatccagggtcctgagtgcactgagtgaccggcagatgtcagaacggatggccttggatgcccggaagcgtgagcagtttcagaggctgaaagaacaatttgtgaaggaccaggagcgacgccaggcggccaggcaggaggagctggatgatgacttcagctacgcccgtgaactccgagacagggagagaaggctgaagtccctggaggaggagctggagaggaaggcgaggtagggcagcccgggctccaggcccaggggtgcagtgcggcaggggccccatagctctggcttaatcttactgatgattttactttttgttttgaaaaccttcaaacatacattaaggtagaaagaccaatatgctgaacccagagtggctgtgggcgttctgccttatccaggcatccttagctgttctgcgcgttgtcttgtggtggtttgtatggattagggtccaggcgaggcctgcgtactgtttggggtcctgtctctttatttatcttctttctgaacatccttccttatttatttttaagtctgttattggtctgacagagacagggcgtttttttttttttttttttttttggaaacagagtcttgctctgtcacccaggctggagtgcagtggcacaatctcggctcactgtaacctccgcctcccaggttcaagcaattctcctgcctcagcctcctgagtagctggggttacaggcatccgccaccacatccagctagttttttgtatttttagtacagacggggtttaaccatgttggccaggctggtctcaaactcctgacctcaggtgatccacctgcctcggcctcccaaagtgctgggattacaggcgcgagccaccgcgctcggctgagacagggcatttgtccagcacagcatctgcgtctgtctccctgtgctgttatcancctgtcctgtgctgtcatcaggctgtcccaggctgagtagtgctggatccttcaaggggctgtttggggttttggagagagcccctcacgggaggggctggccgcttcctgctcagccccacgcgatgctgtaggtcccaaccttagatctctttatggagcgagtgagggatgtgtgtggaggggtgcgcgtgcctgtgtgcacgtgtgtccgtgtatgcatttatgcatgagtacgtgttcatgcatgtatgtcagtcgatactgtcctgttaacacatggagaaaaccaggcctagacactacgtctctggcctgtggcagccaaattagagctggccagtccaggtttgagcccagttgcctgctggtgagaagctcaaaatcatggggcacgatcggtgaagcaggctttgaattcagcaaataaagcgtttgtgttggttttgcttc

SEQ ID NO: 302069 - DNA, 3607 bp, Homo sapiens
  misc_feature (3055)..(3055): n is a, c, g, or t
attcagcctcttcggaccctctctcactccctgtcttccggagcgtgagtgaagcccgggtgaggtgttttcccacacgccgggggcccggagctgagaaggggcatggccagcatcacgcagctgttcgacgacctgtgtgaggccctcctgccggctgccaagactcacctgggccagcgcagtgtgaaccggaagagggcaaagcggagcctcaagaaggtggcctacaatgctcttttcacaaatctttttcaagatgagactcaacagctgcagcctgacatgtcaaaactaccagcgagaaacaagatcctcatgttgtcctttgacttgagagtgggtggcctgggccccaaggccgaccgtttggaggagcttgtggaggagctggaagcagccccttgctgtccgcttttggaggtggggtctgttttggacctcctggttcagctggcagggagtggtccccctcaagttctgccgagaaaacgagactacttccttaacaacaagcatgtggggagaaacgttccgtacagcggctatgattgcgacgacctgagtgtgtttgagatggacgttcagtctctgatctccagagaagagtgtttgtgtcacagcatgatccaggaaacacttcaggttatggaggctgctccaggcactggcctgcccaccgtcgggctcttctcatttggtgacccttgtggtgacaggttcgagagagacacccgggtctcgctcttcggggcccttgtgcacagccgcacttatgacatggacgtccgactgggcctgccccccgtgccagacaatgcggacctctctgggctggctattaaggtcccaccgagtgtggatcagtgggaagacgaaggattccagtcagcgtccaacttgactcctgattcccagtctgagcccagcgtgaccccagacgtggacctgtgggaagccgcacttacctatgaggccagcaagcggagcccccctggccacagagaggagccttacctgacggaggcgggaagggacgctttcgacaagttctgcaggctccaccaaggggagctccagctgcttgctgggggcgtcctacaggccccgcagcccgtgctggtgaaggagtgcgagctggtgaaagacgtgctgaacgtcttgattggggtcgtgtctgccacgttttcgctctgccagccggcccaggcctttgtggtgaagcggggcgtccacgtgtcaggagcgtctcccgagagcatcagcagcctgctctcggaagtggccgagtatgggacctgctacacgcgcctgagtcatttctctctgcagcccgtcctggactctttgtacagcaagggcctcgtgttccaggccttcaccagtggcctgaggaggtacctgcagtattaccgggcctgcgtcctttccactccgcccaccctgagcctcctcaccattggttttctcttcaagaaacttggccggcagctcaggtacctggccgagctctgtggcgttggcgctgtgctcccgggcacctgtggaggaggccccagggccgcgtttcccaccggcgtgaagctgctgtcctacctctaccaggaggctctgcacaactgcagcaacgagcactaccctgtactgctgtccctgctgaagaccagctgcgagccctacacccggttcatccacgactgggtgtacagcggggtgttcagagacgcttatggcgagttcatgattcaggtgaaccacgagtacctcagcttccgagataagtcgtactggacacatggctacgtgctcatctccaaagaggtggaggactgtgttcccgtgtttctgaagcacattgcccacgacatatacgtctgcggaaagaccattaacctgctgaagctctgctgcccccggcattacctctgttggtccgacgtccctgtcccccggatctcggtgattttctcccttgaggagttgaaggagattgagaaggactgtgccgtctacgttgggcgcatggagagggtggcccgccacagctctgtcagcaaggaggagaaggaattacgtatggaaattgcaaaacaagaattaatcgctcatgcccgggaagcagcatccagggtcctgagtgcactgagtgaccggcagatgtcagaacggatggccttggatgcccggaagcgtgagcagtttcagaggctgaaagaacaatttgtgaaggaccaggagcgacgccaggcggccaggcaggaggagctggatgatgacttcagctacgcccgtgaactccgagacagggagagaaggctgaagtccctggaggaggagctggagaggaaggcgaggtagggcagcccgggctccaggcccaggggtgcagtgcggcaggggccccatagctctggcttaatcttactgatgattttactttttgttttgaaaaccttcaaacatacattaaggtagaaagaccaatatgctgaacccagagtggctgtgggcgttctgccttatccaggcatccttagctgttctgcgcgttgtcttgtggtggtttgtatggattagggtccaggcgaggcctgcgtactgtttggggtcctgtctctttatttatcttctttctgaacatccttccttatttatttttaagtctgttattggtctgacagagacagggcgtttttttttttttttttttttttggaaacagagtcttgctctgtcacccaggctggagtgcagtggcacaatctcggctcactgtaacctccgcctcccaggttcaagcaattctcctgcctcagcctcctgagtagctggggttacaggcatccgccaccacatccagctagttttttgtatttttagtacagacggggtttaaccatgttggccaggctggtctcaaactcctgacctcaggtgatccacctgcctcggcctcccaaagtgctgggattacaggcgcgagccaccgcgctcggctgagacagggcatttgtccagcacagcatctgcgtctgtctccctgtgctgttatcancctgtcctgtgctgtcatcaggctgtcccaggctgagtagtgctggatccttcaaggggctgtttggggttttggagagagcccctcacgggaggggctggccgcttcctgctcagccccacgcgatgctgtaggtcccaaccttagatctctttatggagcgagtgagggatgtgtgtggaggggtgcgcgtgcctgtgtgcacgtgtgtccgtgtatgcatttatgcatgagtacgtgttcatgcatgtatgtcagtcgatactgtcctgttaacacatggagaaaaccaggcctagacactacgtctctggcctgtggcagccaaattagagctggccagtccaggtttgagcccagttgcctgctggtgagaagctcaaaatcatggggcacgatcggtgaagcaggctttgaattcagcaaataaagcgtttgtgttggttttgcttcatgtgcttttttgcattagttttcagttctcaggtttgtacctgtagaaggggaagaggcctaacttcttagaggcctggggccctcggcctcctgctc

SEQ ID NO: 302070 - DNA, 1834 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302071 - DNA, 2018 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302072 - DNA, 2204 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatggaaaagcaacaagacaaacacacacaaaaaaaaccacaaacaagaatactgaagcacaaaatggggcggccacaccacgaagaaaccacgggcgagggacagggaaaagcaacagaaaacccgaaataaaggaagagggggggggcccaaaaagacatcgcgagagaacgcccacatcggccccgcgc

SEQ ID NO: 302073 - DNA, 1914 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggggggccagccattgtctcccacttggggagtttcttcctggcatcatgccttctgaataaatgccgattttatccatgga

SEQ ID NO: 302074 - DNA, 1939 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302075 - DNA, 2146 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaagaggagcgagggcagtgggctgggagggcgccgtggtgatgcagctgccctgcccagtaggcaccggggggagcgggatggtccctggaggagcctcctctcctccccccaaccctaacctcaggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302076 - DNA, 1949 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagtttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302077 - DNA, 2112 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggacttgtaagtgaggggtgctaggaggggtgtggaggtggcgattggggctgggacccacacagccccgtccatctcccctgtctggtatttgttgcagtttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302078 - DNA, 1987 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggtgagtattcccgcccaccctcatggaacgaccacctctggctcgcagcccacctgaggggaatgagagctgactcggccccgggaggacacgcaaggagcggtcgtgcacctgagagtaggtgggggtcatgccctcttctcgctctcccaggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302079 - DNA, 1874 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302080 - DNA, 1787 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302081 - DNA, 1801 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302082 - DNA, 1721 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302083 - DNA, 1874 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302084 - DNA, 1649 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302085 - DNA, 1545 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggtggacccaggcccaacgccgatcccccacaacagctcatcacgatttgactgcaactctgtctctacggctcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302086 - DNA, 1987 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaagaggagcgagggcagtgggctgggagggcgccgtggtgatgcagctgccctgcccagtaggcaccggggggagcgggatggtccctggaggagcctcctctcctccccccaaccctaacctcaggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302087 - DNA, 1810 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagatggagtctcgctctgttgcccaggctggaatgtagcggtgcaatcttggctcactgcaacccctgcctcccagattcaagcgattctcaagcctcagccttccgagtagctgggattacagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302088 - DNA, 1028 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctccagctccagcctctcccttcgggaaaggtggacagtgttcaagtctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302089 - DNA, 1938 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302090 - DNA, 2191 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagttcggatgatggctggggtatgtccctgtggggcttgctcacctccaggccccccgcttatatcttctgccttttccagggtctgctgtggtacattgttcccttggtcgtagtttactttgccgagtatttcattaaccagggacttgtaagtgaggggtgctaggaggggtgtggaggtggcgattggggctgggacccacacagccccgtccatctcccctgtctggtatttgttgcagtttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302091 - DNA, 1632 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302092 - DNA, 1929 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaagaggagcgagggcagtgggctgggagggcgccgtggtgatgcagctgccctgcccagtaggcaccggggggagcgggatggtccctggaggagcctcctctcctccccccaaccctaacctcaggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302093 - DNA, 1642 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302094 - DNA, 1563 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302095 - DNA, 1926 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagagacagagttttgctcttgtagctcaggctagagtacaatggcgtgatcttggctcactgcaacctccgcctcccaggttcaggcgattcttctgcctcagcctcctgcgtagctgggattacagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 302096 - DNA, 1447 bp, Homo sapiens
cgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccagctccagctcagctctccttcgggaaaggggccggtcagggctgcggggtacatgtcccggccgaagtactggcggagaatcataccagggcctggaacccccttctggaatcccgacgcgccgaacggggccaagcgccgggggtggcccccaaccgggggcaccaccgggggcgcggggcaccggtcgggag

SEQ ID NO: 302097 - DNA, 756 bp, Homo sapiens
  misc_feature (2)..(3): n is a, c, g, or t
gnnagacactctccaaaaagcagagacagcaggaagaggggagtggaggcagcccattcacctggggaaatgactgggttgtcgatggacggtggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaacgcctgcctcgtgccacctcatgcttataataaagccggcgtcagagaccgctgcttccctcaacctgcctgcctgtctccctcctctgtcaccaccagcctctccaagctcaagtacaaatacagccgggtctcaaaaaaaaaaaaaaaaaaaaaacaaaaaaaagaaaaaaaaaaaagaaaaaaaaaaaaaaaaaaaaaaaagaaaccagaaaacaaaagagaaaccaaacgatgaaaatgaacaaaatcaagaaaacaagacgaggcgcacgccaaaaagaaagacggagagcggaaaaagaaacacag

SEQ ID NO: 302098 - DNA, 494 bp, Homo sapiens
cccaggcaagcagcacctccctgctctcctgcactcctggacacaaccagcagctcctgccatggacaggtggtacctgggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaacgcctgcctcgtgccacctcatgcttataataaagccggcgtcagagaccgctgcttccctcaa

SEQ ID NO: 302099 - DNA, 916 bp, Homo sapiens
ctctcctgccacctcagccttccagagtacccagcccctcttcctgtcggcctcctctctaagaaaatttgcaacttaaaggaggaccctgctttaaccccaaagaaagatagcttgagtggcagaaaggcagcagatagaagctggagagctgagcgttcctcctcggcctcctggcacacacccgccctgagttcaatgcatcttgctagaccgtctgaacttgggcgggaggcagacggcgtccatctggctggggaaggagcaggcccctctggtcagccttcctaggctggatttggggtgagagcccgccaagttcaagtcacactctccaaaggcttcctgtcacaggaactgactcaggcctggaaaccaagaggggcacttgctgacagaggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaacgcctgcctcgtgccacctcatgcttataataaagccggcgtcagagaccgctgcttccctcaaaaaaacaaggggggcaaagtcccgagggccattccgtacccgttttgtgcaaggccaagggcgcttaacgagggcgcggaaccctggaacaccggttgggaa

SEQ ID NO: 302100 - DNA, 855 bp, Homo sapiens
  misc_feature (503)..(503): n is a, c, g, or t
  misc_feature (507)..(507): n is a, c, g, or t
  misc_feature (509)..(509): n is a, c, g, or t
cccaggcaagcagcacctccctgctctcctgcactcctggacacaaccagcagctcctgccatggacaggtggtacctgggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaacgcctgcctcgtgccacctcatgcttataataaagccggcgtcagagaccgctgcttccctcaaaaaaaaaanaaananaaaaaaaaaagggggggggggcaaaagttcccctgggggggcccaggtttatacgcgttccccgggttttgtgtggctcgcagtgggccccatattggggagcgccggatattttataagaccgcatggcgcacgggggcgcgcgctgttttcaccacagcggtctcgtggcgtggggagacaaccctggtgctaccgtgggagagactcttgtggccgaagggggaactcttatctctttggggggggggggccacatatgtggggacaacctttccctttccaagatagatttaacgggctagagcaggacattttacacttttacaagggggataagcggggc

SEQ ID NO: 302101 - DNA, 802 bp, Homo sapiens
  misc_feature (401)..(401): n is a, c, g, or t
  misc_feature (497)..(497): n is a, c, g, or t
  misc_feature (582)..(582): n is a, c, g, or t
cccaggcaagcagcacctccctgctctcctgcactcctggacacaaccagcagctcctgccatggacaggtggtacctgggcggcagccccaagggggacgtggacccgttctactatgactatgagaccgttcgcaatgggggcctgatcttcgctggactggccttcatcgtggggctcctcatcctcctcatccttccttcaggcagaaggatttccggctggtggtggggccattaaggaaggcggccgaggccaattccatggaaggattgaagccgcgttaaccagccgagcctctcggcgcggttgcacacccacatgtgacatcgtggtggcccagctcgtgggaaagcccagagactagtggtcctcttgctcttcgtggcgctcctccccntttcttcctcgtggggtctttaagacctctttggtcccgcgtgtcacgttgccgatgcgggctttggggcgttgaaggggaatgcctccgagacgntcaagttgttggaccccccatggggttgggcatttccgcccaatctcgcttgtccctccgttgccaacccttcgaattgcttatnaaattaaaaggcccgggcggttccaggagaacccgggctggtgctttcccttcaaaaaagacagacacatatagacatagacacgaagacagacagacagacacaaacacagagaagaagagagagagaagagaagaacacagagagagagacagaacaacgaagagcgcgggcgcgcgcgcgcgcgcgcactacagaagagtgatgtataccccgcgca

SEQ ID NO: 302102 - DNA, 1288 bp, Homo sapiens
cggcaatgcctgaaacataacaatgcctaaaacatgatagtcctccaataaaagcataatgaataaataagctaggaacttgaggacatcccaaagccatcttctctcactcaccccgtatttaattggcactaagtcctaatgactctatctctacttcctctttgccatccctatggccactgcctttaagtattcaatctcctccaattttatgttcctctaattcatcctctatatctttagtgcctggaagaagtttccacaggaatgatatcttgcttatcattatatcccaatgcctggattaaaacagttaataaaactagctggataaacaaatgaaatattcatgggaaaagggatggatgaatgaacaaataaacgagtggtacataattttagattctcagactgctacattaaatttaacaggtgtttaaaagattctcacttaaaattagaagaaagtttatggatccatttaagctagcccaatttcactcttatgcaaagctgtactttattgcacaaaaatcaaaaaggcttgagaacttcttgcaggaagaggggagtggaggcagcccattcacctggggaaatgactgggttgtcgatggacggtggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaacgcctgcctcgtgccacctcatgcttataataaagccggcgtcagagaccgctgcttccctcaacctgcctgcctgtctccctcctctgtcaccaccagcctctccaagctcaagtacaaatacagccgggtctcaaaaaaaaaaaaaaaaaaaaaacaaaaaaaagaaaaaaaaaaaagaaaaaaaaaaaaaaaaaaaaaaaagaaaccagaaaacaaaagagaaaccaaacgatgaaaatgaacaaaatcaagaaaacaagacgaggcgcacgccaaaaagaaagacggagagcggaaaaagaaacacag

SEQ ID NO: 302103 - DNA, 869 bp, Homo sapiens
  misc_feature (2)..(3): n is a, c, g, or t
  misc_feature (517)..(517): n is a, c, g, or t
  misc_feature (521)..(521): n is a, c, g, or t
  misc_feature (523)..(523): n is a, c, g, or t
gnnagacactctccaaaaagcagagacagcaggaagaggggagtggaggcagcccattcacctggggaaatgactgggttgtcgatggacggtggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaacgcctgcctcgtgccacctcatgcttataataaagccggcgtcagagaccgctgcttccctcaaaaaaaaaanaaananaaaaaaaaaagggggggggggcaaaagttcccctgggggggcccaggtttatacgcgttccccgggttttgtgtggctcgcagtgggccccatattggggagcgccggatattttataagaccgcatggcgcacgggggcgcgcgctgttttcaccacagcggtctcgtggcgtggggagacaaccctggtgctaccgtgggagagactcttgtggccgaagggggaactcttatctctttggggggggggggccacatatgtggggacaacctttccctttccaagatagatttaacgggctagagcaggacattttacacttttacaagggggataagcggggc

SEQ ID NO: 302104 - DNA, 965 bp, Homo sapiens
cggcaatgcctgaaacataacaatgcctaaaacatgatagtcctccaataaaagcataatgaataaataagctaggaacttgaggacatcccaaagccatcttctctcactcaccccgtatttaattggcactaagtcctaatgactctatctctacttcctctttgccatccctatggccactgcctttaagtattcaatctcctccaattttatgttcctctaattcatcctctatatctttagtgcctggaagaagtttccacaggaatgatatcttgcttatcattatatcccaatgcctggattaaaacagttaataaaactagctggataaacaaatgaaatattcatgggaaaagggatggatgaatgaacaaataaacgagtggtacataattttagattctcagactgctacattaaatttaacaggtgtttaaaagattctcacttaaaattagaagaaagtttatggatccatttaagctagcccaatttcactcttatgcaaagctgtactttattgcacaaaaatcaaaaaggcttgagaacttcttgcaggaagaggggagtggaggcagcccattcacctggggaaatgactgggttgtcgatggacggtggcggcagccccaagggggacgtggacccgttctactatggcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaacgcctgcctcgtgccacctcatgcttataataaagccggcgtcagagaccgctgcttccctcaa

SEQ ID NO: 302105 - DNA, 335 bp, Homo sapiens
gagatcacagaggagccctggagaaaagtgagatggacaagggggaagtaaaaccccaacctctgctgcctcccacccaaccccatcctgcctttgtcttctcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaacgcctgcctcgtgccacctcatgcttataataaagccggcgtcagagaccgctgcttccctc

SEQ ID NO: 302106 - DNA, 508 bp, Homo sapiens
  misc_feature (2)..(3): n is a, c, g, or t
gnnagacactctccaaaaagcagagacagcaggaagaggggagtggaggcagcccattcacctggggaaatgactgggttgtcgatggacggtggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaacgcctgcctcgtgccacctcatgcttataataaagccggcgtcagagaccgctgcttccctcaa

SEQ ID NO: 302107 - DNA, 442 bp, Homo sapiens
gctgcggagagagacagctgctgggagagaccacccatcccgctcctcttgccctctctttccggagactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaacgcctgcctcgtgccacctcatgcttataataaagccggcgtcagagaccgctgcttccctcaa

SEQ ID NO: 302108 - DNA, 542 bp, Homo sapiens
ggcaaacagcaacctttcgctgttctcaacttgcacttcacgtgtgacactaaccgagtcagcatcctgccgatgaggaggtggtgtgtaccgtgcgagcggctgtccccaatggggagtacgtgtcaatctcggattactacttatgactactgatgacgcgtttctggaaatgggtgagccgtgttactctatcagacgtaggtacatggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaacgcctgcctcgtgccacctcatgcttataataaagccggcgtcagagaccgctgcttccctcaa

SEQ ID NO: 302109 - DNA, 684 bp, Homo sapiens
  misc_feature (2)..(3): n is a, c, g, or t
gnnagacactctccaaaaagcagagacagcaggaagaggggagtggaggcagcccattcacctggggaaatgactgggttgtcgatggacggtggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaacgcctgcctcgtgccacctcatgcttataataaagccggcgtcagagaccgctgcttccctcaaaaaaaaaaaaaaaaaaaaaaacaaaaaaaagaaaaaaaaaaaagaaaaaaaaaaaaaaaaaaaaaaaagaaaccagaaaacaaaagagaaaccaaacgatgaaaatgaacaaaatcaagaaaacaagacgaggcgcacgccaaaaagaaagacggagagcggaaaaagaaacacag

SEQ ID NO: 302110 - DNA, 3385 bp, Homo sapiens
ggtttactcttacgccactgacgtaacgtcatcgtgcgggacgtggacggaagaaaaaagagagtgagcgagcgccggaatcagcccggcgtggagtgcggacccgcggtagtgccagggggcgaaggcggcggtggtgaggaagatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcc

SEQ ID NO: 302111 - DNA, 633 bp, Homo sapiens
atgctggagacactaacaccatgctatgctgcatgcactaacaccagaagtttggcataaacaagatggaaaagttgtgagagaaacttgtcatggagcagtgactgcataagctcttctgaactcgtggttgcattcaacagggtgaggtgctatagtcactgaagatggtgcgatgagcatggcttgtatatttcagtggctagaagactgcatgtttggaaaaaggattgccagtagacagtgtgttctgcagacagaaggggcctgcaagagccgtcatctacatatttgggttcattggttttgcctgatcctagcttggttttgcctgagcttggctgtgttcttccatgaatttctttttggactgcttagctcactcacttatgactttttaatctgcattctaggttattagtgttaaagataatgatagcctggctgcccgactggctgtggaaatgaaaactgatctcttgattgttctttcagatgtagaaggtacaaagtaatgcttttttcctttatctgccctttgttttaaatgctacatatgtgagcacatgagtttccctctttctttgagtccctctgatgttttttgctatagatcattagccatatgttctg

SEQ ID NO: 302112 - DNA, 3664 bp, Homo sapiens
ggtttactcttacgccactgacgtaacgtcatcgtgcgggacgtggacggaagaaaaaagagagtgagcgagcgccggaatcagcccggcgtggagtgcggacccgcggtagtgccagggggcgaaggcggcggtggtgaggaagatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaacttgtggcccccttggccccaacgctttttaaatttcgaaaagttttttttggggccccgaattggggctcctttggcaaattccccctattggggggccaattaaaatacatgggcctgtttttaaaaaccggtggatcgga

SEQ ID NO: 302113 - DNA, 3331 bp, Homo sapiens
ggtttactcttacgccactgacgtaacgtcatcgtgcgggacgtggacggaagaaaaaagagagtgagcgagcgccggaatcagcccggcgtggagtgcggacccgcggtagtgccagggggcgaaggcggcggtggtgaggaagatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccattgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcc

SEQ ID NO: 302114 - DNA, 3591 bp, Homo sapiens
ggtttactcttacgccactgacgtaacgtcatcgtgcgggacgtggacggaagaaaaaagagagtgagcgagcgccggaatcagcccggcgtggagtgcggacccgcggtagtgccagggggcgaaggcggcggtggtgaggaagatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagccaaaaaaaaaaaaaaaaaaaaaaaaaaacaaaaaaaaaaaaaaaaaaaaaaaaaaaaaaaaaaacttgtggcccccttggccccaacgctttttaaatttcgaaaagttttttttggggccccgaattggggctcctttggcaaattccccctattggggggccaattaaaatacatgggcctgtttttaaaaaccggtggatcgga

SEQ ID NO: 302115 - DNA, 3536 bp, Homo sapiens
ggtttactcttacgccactgacgtaacgtcatcgtgcgggacgtggacggaagaaaaaagagagtgagcgagcgccggaatcagcccggcgtggagtgcggacccgcggtagtgccagggggcgaaggcggcggtggtgaggaaggtacgcggcgagcggcggggatggctaggcgcccgcgtctctgcggaagctgttgcgcgcccaggctcaagcgcgaggggcgtgagcgccgggccgctggagcggggacgctgccggagcaggtgccggggcccggggatctggcccatggatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcc

SEQ ID NO: 302116 - DNA, 3417 bp, Homo sapiens
ggtttactcttacgccactgacgtaacgtcatcgtgcgggacgtggacggaagaaaaaagagagtgagcgagcgccggaatcagcccggcgtggagtgcggacccgcggtagtgccagggggcgaaggcggcggtggtgaggaagatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttgctacacctccccctcaccaaacacatcaaaacctccttctcgaaacacaccacccaacacaacaaacaagttcgaac

SEQ ID NO: 302117 - DNA, 3110 bp, Homo sapiens
taatttcgagtcgccggggcaggggcttccgtgtattacctggtgccccttgactttagcaacatctatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcc

SEQ ID NO: 302118 - DNA, 2681 bp, Homo sapiens
aaaaaacatggcaggacaagcgcggttatttcggacgaaggttgataccatgcatatgcagatccttgcctggaactcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcc

SEQ ID NO: 302119 - DNA, 2908 bp, Homo sapiens
atgctggagacactaacaccatgctatgctgcatgcactaacaccagaagtttggcataaacaagatggaaaagttgtgagagaaacttgtcatggagcagtgactgcataagctcttctgaactcgtggttgcattcaacagggtgaggtgctatagtcactgaagatggtgcgatgagcatggcttgtatatttcagtggctagaagactgcatgtttggaaaaaggattgccagtagacagtgtgttctgcagacagaaggggcctgcaagagccgtcatctacatatttgggttcattggttttgcctgatcctagcttggttttgcctgagcttggctgtgttcttccatgaatttctttttggactgcttagctcactcacttatgactttttaatctgcattctaggttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcc

SEQ ID NO: 302120 - DNA, 2577 bp, Homo sapiens
ccttctttttcagttctgtccttaaagcacagcatcataagtagcaatggcagaattaaggacaccttgccaggaatatgggcagggctaataaatgttgtgctgaggatatggccatgatctgatgttgggaaacatttatttattaagccaggttatagaaataatgtaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcc

SEQ ID NO: 302121 - DNA, 3610 bp, Homo sapiens
ggtttactcttacgccactgacgtaacgtcatcgtgcgggacgtggacggaagaaaaaagagagtgagcgagcgccggaatcagcccggcgtggagtgcggacccgcggtagtgccagggggcgaaggcggcggtggtgaggaagatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacagggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaacttgtggcccccttggccccaacgctttttaaatttcgaaaagttttttttggggccccgaattggggctcctttggcaaattccccctattggggggccaattaaaatacatgggcctgtttttaaaaaccggtggatcgga

SEQ ID NO: 302122 - DNA, 2203 bp, Homo sapiens
gtatcacgcttggtaccttctatgcagaagtcgagaccatggaggtcctacatgtggaggtatgatcgataacttggtgcgatctgaaggaaggatgttggacgagcgttggatctcgtgaggctcgagcagcataaatagtatgatccatttcatctggcgttagtatcgtgctatgattggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcc

SEQ ID NO: 302123 - DNA, 1828 bp, Homo sapiens
gaaggagtgcttgtgaatgctaacatcactgttgctattactgtttgtctcctttgatccactgctctccctttgatctgcaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcc

SEQ ID NO: 302124 - DNA, 1225 bp, Homo sapiens
tccacacactgtttcacgagaaggagtgtatcatgatttgtagtaatcgaagaacatgtttatgggaacagggtgactcagctctcctggggaggatggatgaggagttagcaggaagagagggtaccaagtgaggggaaagcagcagggtgggtctggggcatggacaggaagcagaggctgggaaaagctacatcttttattcatgctttttcacaggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcc

SEQ ID NO: 302125 - DNA, 941 bp, Homo sapiens
gtgaaggatcccgtctgagcagctgggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcc

SEQ ID NO: 302126 - DNA, 756 bp, Homo sapiens
taatcaccgactttactggtatccgtctgcattttacgcatggtgtaccttcgatccttctgcgtgctccgttgtggtcactagcatctcttgttggaaaacttcgtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcc

SEQ ID NO: 302127 - DNA, 163 bp, Homo sapiens
gaagggatctgtcacatgtatgtggattccgaggccagtgttgataaggtcaccaggctaggtgagctggatggggtcttctctttcacaacggagaaatattacatcctctgcagctctggatcatgtcaatggaaacaattctttgctcatcttctttcag

SEQ ID NO: 302128 - DNA, 1537 bp, Homo sapiens
agcggagcagtccccggtgtcggggcaggaggcacgcgcgcggctgaggcgaggtcgctcggcgcagctgttgcggggccatggcggggaccgcgctcaagaggctgatggccgagtacaaacccttgagaacgtgcagtgagagcttgaggaagaaggcctgacttgctgctgcggaattaggagggaaaagtgtatgcgttaaaaggggaaaggctcgttggtggagctttgaaaggtcagattttggctttccctctaatgaaggaaaagggtttttgaacagtgccacctgtcactcctcctaggtagtgttgaggaaacctcttgagtgctttcctacccggtaaattagatatttctaatgtctgaggagagcgaagggagaaatgagaacctaggaacactcggcattccatcgttttacaccgaatgcccgcttggaagaactgctgcgagaagtcttggaataccattgtgttgaaagcgccaggagcctgagtcgccgatggagacgagatagtagccggctaagagcagggcctgagttcagacccggcctctctgcttgttagctctttgaccttgttcctctctctgtctctgcagtttccttgtcttaaaaggttaaacttgatactgcaggtgaagtgcttagcaaaatacctgatgtgtaacccttaataaagttagctgctgcttttgtaattagattgaggataattttggaagaaagttaagctaaaagaatgaatgtgagaaaaaaaataagtggtgaatatacatgtagcttgatttcgtaaaactattggtgacaccgcccagtaagagttgatgtttggcttaagcagaccaaaacgttgcaaatacaggctcactcacgtatggtcattcttcccttggtatctggaggggattggttccaggccccgctgcagataccagaatcctcggatgctcaagtccctactataaggtggcgtggtatttgcatttaatgtatgcatagcctctcataacttttaaatcatctcaaggttacttatagtacctaatgcaatgtaagtgctgcacaaatagttacactgattttttttacttgtatttttaaatcgtcattttttattgttatttttttcaaatattttgtattcctggttggtcgaatccatggatatgcagccgcagatacacagggcctcctgtaaacgttcaaataacgctcgccacctagtgttctgctaaagcagaacataaaggcacacctcagtttcccgcgcgctttgctttattgagcttcacttcgcagatcttgcattttttacaagtttacaagttttttacaagcaaccctgcatggaagcaagtctgttggcaccatttttgctcgcttcgtgtctctctcttacattttaatctattactgtgatctatgatcagtaatctttgatgttactattgtaattattttggggcatcacaaactatgcccataaaagatggtagtcctaataaatgttgtgtgtgcttcactgac

SEQ ID NO: 302129 - DNA, 2917 bp, Homo sapiens
agcggagcagtccccggtgtcggggcaggaggcacgcgcgcggctgaggcgaggtcgctcggcgcagctgttgcggggccatggcggggaccgcgctcaagaggctgatggccgagtacaaacaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcacacacaccgccaatcagctcagcattctcccccggcacacttagtgacagtgatgctctgtgctggtaccaaacaaggcagacttgcaagaaccacggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaaattttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcgcgccactgcactccagcctgggcaacagagtgagactctgtctcaaaaaaaaaaaaaaaaaaaaaatggaacgcagggcaagaactcgtatttggaaggagatgggggaaaggagcggtattatacctaagttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgca

SEQ ID NO: 302130 - DNA, 871 bp, Homo sapiens
tacttagaaatttagtaattgttgtacaaaaatgagagcagtctttttcacttcttgatatttccagagtccatcccttttctagatttaattcttaaataacacatagtactacttatatagttaggcaaatctaattatattcttgattaatcaataaatgaactttgctaattccagttatagtttagtatagctgattttttaagcacctgcaaatataacaagtgaaatcctgtgatatacttaagcaacccttgtaaatcaaataaattttacttataaatgtagtaaatcaccatcctgtttcaaaagacttaaaaacaaagcacacacacaaagtagctgatgaataaaaacttgttgctataccttgaaaaatacaacatacataaattatcaatataatatttgtttcttcagctcaaccaagaagactagaatgtccatctaagcctcactggagcaaatgatattatgcattcagtttacagagtgagactctgtctcaaaaaaaaaaaaaaaaaaaaaatggaacgcagggcaagaactcgtatttggaaggagatgggggaaaggagcggtattatacctaagttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgca

SEQ ID NO: 302131 - DNA, 484 bp, Homo sapiens
agcggagcagtccccggtgtcggggcaggaggcacgcgcgcggctgaggcgaggtcgctcggcgcagctgttgcggggccatggcggggaccgcgctcaagaggctgatggccgagtacaaacccttgagaacgtgcagtgagagcttgaggaagaaggcctgacttgctgctgcggaattaggagggaaaagtgtatgcgttaaaaggggaaaggctcgttggtggagctttgaaagaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacagtaagtgcttttggaagtagtttttgtggtaccaggataggtacg

SEQ ID NO: 302132 - DNA, 3059 bp, Homo sapiens
  misc_feature (2936)..(2936): n is a, c, g, or t
  misc_feature (2938)..(2938): n is a, c, g, or t
agcggagcagtccccggtgtcggggcaggaggcacgcgcgcggctgaggcgaggtcgctcggcgcagctgttgcggggccatggcggggaccgcgctcaagaggctgatggccgagtacaaacaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcacacacaccgccaatcagctcagcattctcccccggcacacttagtgacagtgatgctctgtgctggtaccaaacaaggcagacttgcaagaaccacggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaaattttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcgcgccactgcactccagcctgggcaacagagtgagactctgtctcaaaaaaaaaaaaaaaaaaaaaatggaacgcagggcaagaactcgtatttggaaggagatgggggaaaggagcggtattatacctaagttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgcaaaaaattaaaaaacaaaantntggttcacttggggggggggccgggtccccaattccccttatggggaggtgtttaacattcaatgggccgtggttttaaaccatcttgaactggaaaaacctggcctttcccaagcttaat

SEQ ID NO: 302133 - DNA, 2852 bp, Homo sapiens
agcggagcagtccccggtgtcggggcaggaggcacgcgcgcggctgaggcgaggtcgctcggcgcagctgttgcggggccatggcggggaccgcgctcaagaggctgatggccgagtacaaacaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcacacacaccgccaatcagctcagcattctcccccggcacacttagtgacagtgatgctctgtgctggtaccaaacaaggcagacttgcaagaaccacggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaaattttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcgcgccactgcactccagcctgggcaacagagtgagactctgtctcaaaaaaaggtattatacctaagttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgca

SEQ ID NO: 302134 - DNA, 2473 bp, Homo sapiens
agcggagcagtccccggtgtcggggcaggaggcacgcgcgcggctgaggcgaggtcgctcggcgcagctgttgcggggccatggcggggaccgcgctcaagaggctgatggccgagtacaaacaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcacacacaccgccaatcagctcagcattctcccccggcacacttagtgacagtgatgctctgtgctggtaccaaacaaggcagacttgcaagaaccacggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaaattttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctggattacaggcttgggccacggcccagccaatgtcctagagagttccgtgatctgaatccttatgtattattgtagctatattcatacaaagtgctttaagtgtgcagagtcattaaccctttctcctaaaatacggattggcagcctcgggaaatcggtccctcggatccaacaacttaccttgcaacaaa

SEQ ID NO: 302135 - DNA, 3032 bp, Homo sapiens
agcggagcagtccccggtgtcggggcaggaggcacgcgcgcggctgaggcgaggtcgctcggcgcagctgttgcggggccatggcggggaccgcgctcaagaggctgatggccgagtacaaacccttgagaacgtgcagtgagagcttgaggaagaaggcctgacttgctgctgcggaattaggagggaaaagtgtatgcgttaaaaggggaaaggctcgttggtggagctttgaaagaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcacacacaccgccaatcagctcagcattctcccccggcacacttagtgacagtgatgctctgtgctggtaccaaacaaggcagacttgcaagaaccacggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaaattttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcgcgccactgcactccagcctgggcaacagagtgagactctgtctcaaaaaaaaaaaaaaaaaaaaaatggaacgcagggcaagaactcgtatttggaaggagatgggggaaaggagcggtattatacctaagttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgca

SEQ ID NO: 302136 - DNA, 2835 bp, Homo sapiens
agcggagcagtccccggtgtcggggcaggaggcacgcgcgcggctgaggcgaggtcgctcggcgcagctgttgcggggccatggcggggaccgcgctcaagaggctgatggccgagtacaaacgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcacacacaccgccaatcagctcagcattctcccccggcacacttagtgacagtgatgctctgtgctggtaccaaacaaggcagacttgcaagaaccacggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaaattttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcgcgccactgcactccagcctgggcaacagagtgagactctgtctcaaaaaaaaaaaaaaaaaaaaaatggaacgcagggcaagaactcgtatttggaaggagatgggggaaaggagcggtattatacctaagttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgca

SEQ ID NO: 302137 - DNA, 2972 bp, Homo sapiens
aaggaactagctctgaaaagtattgtaaataatcctaatcacattagatattttgataaaatatttgccagataacctttcatttagtctttttgtatatattgcttgaaaaaaattcatatgaaagtggattagactacgacagctgattagaactggctgggtcagcctggagcctgtcagtgagtgagcaggccccaccgggattcctgcagacatgaagcgtgacactcagggccccaggctatgccccagctgtgcaaacagcttggttgctgtgtctgcagtctttgttctcattatctgtggagcctgcccaagcgcggcgatgcctcgggcaccattcctgggctcacttggctgcctctgacccttgcagtctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcacacacaccgccaatcagctcagcattctcccccggcacacttagtgacagtgatgctctgtgctggtaccaaacaaggcagacttgcaagaaccacggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaaattttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcgcgccactgcactccagcctgggcaacagagtgagactctgtctcaaaaaaaaaaaaaaaaaaaaaatggaacgcagggcaagaactcgtatttggaaggagatgggggaaaggagcggtattatacctaagttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgca

SEQ ID NO: 302138 - DNA, 3017 bp, Homo sapiens
agcggagcagtccccggtgtcggggcaggaggcacgcgcgcggctgaggcgaggtcgctcggcgcagctgttgcggggccatggcggggaccgcgctcaagaggctgatggccgagtacaaacaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatgtcaccctatgggaccaactcctggagaaggcaacacagaagtgggaaacttcctgattttgtggatgtggatcttaggtggacagcctgatgtccaggtctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcacacacaccgccaatcagctcagcattctcccccggcacacttagtgacagtgatgctctgtgctggtaccaaacaaggcagacttgcaagaaccacggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaaattttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcgcgccactgcactccagcctgggcaacagagtgagactctgtctcaaaaaaaaaaaaaaaaaaaaaatggaacgcagggcaagaactcgtatttggaaggagatgggggaaaggagcggtattatacctaagttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgca

SEQ ID NO: 302139 - DNA, 1702 bp, Homo sapiens
  misc_feature (10)..(10): n is a, c, g, or t
  misc_feature (12)..(12): n is a, c, g, or t
  misc_feature (14)..(14): n is a, c, g, or t
  misc_feature (20)..(20): n is a, c, g, or t
aaggctagtngngnctgggngtaatcggccgagggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaaattttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcgcgccactgcactccagcctgggcaacagagtgagactctgtctcaaaaaaaaaaaaaaaaaaaaaatggaacgcagggcaagaactcgtatttggaaggagatgggggaaaggagcggtattatacctaagttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgca

SEQ ID NO: 302140 - DNA, 1802 bp, Homo sapiens
ccaagatctttgagcatcaccaccaaatctactgataattaaaagataacaggatattatgataactcggagggacaacaagcttgaaaacttagaaaggacaattccttgaaaatcacattttctaaaatgatataactagaaacagaaaatctggatagtctttgaactttcaaagaaattgaggtcgtatcttgaaatctccataccaaatgtccaagaaaaatattgggcccagacggctttgttgatgaactcttccaaacatttaagttagaaacactacgagccaggcacagtggctgactagcctgtagtccatcattttgggaagccaaggcagatggatagcttgatcccagaagttcaactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaaattttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcgcgccactgcactccagcctgggcaacagagtgagactctgtctcaaaaaaaaaaaaaaaaaaaaaatggaacgcagggcaagaactcgtatttggaaggagatgggggaaaggagcggtattatacctaagttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgca

SEQ ID NO: 302141 - DNA, 789 bp, Homo sapiens
agcggagcagtccccggtgtcggggcaggaggcacgcgcgcggctgaggcgaggtcgctcggcgcagctgttgcggggccatggcggggaccgcgctcaagaggctgatggccgagtacaaacaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcacacacaccgccaatcagctcagcattctcccccggcacacttagtgacagtgatgctctgtgctggtaccaaacaaggcagacaaatgtgtaggttctgtgggttttcattttcttgatggcatcctttgaagcacagaagtttaattttgatgaagttcaatttacccatttggctctgttttcattc

SEQ ID NO: 302142 - DNA, 822 bp, Homo sapiens
agcggagcagtccccggtgtcggggcaggaggcacgcgcgcggctgaggcgaggtcgctcggcgcagctgttgcggggccatggcggggaccgcgctcaagaggctgatggccgagtacaaacaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatgtcaccctatgggaccaactcctggagaaggcaacacagaagtgggaaacttcctgattttgtggatgtggatcttaggtggacagcctgatgtccagggcaagtatgcatctagtttcttccactctccttgaatgagaagttgtggttcagttcctggatagtagagcgttcaccactgaacgttcaccactgaaacaatggatgagtggaaacacataggaccaggtatgaaagacaagactgtttgaaggtaagtgatcgccattcacatttgtgaattttcatgaaattcagagcttattaactcaggtgagttaaataaatgtattttaaaattgctatttctattattataactttaatggctttataattttacagttgagtctatctagatggattactgcatatctgagtatatatggagccatctgagaattcctcccaattttatgtaaaagaggactgattaaatgctgtgaattgaaaattta

SEQ ID NO: 302143 - DNA, 885 bp, Homo sapiens
gaggcacgcgcgcggctgaggcgaggtcgctcggcgcagctgttgcggggccatggcggggaccgcgctcaagaggctgatggccgagtacaaacgtgagtctggggacccgggccgtcagcagcgtcccgcgttcctgctcccgggcccgcgtcgtccggcggggctggggcagggagcctggcgggggagccgggcccggggcctccaccgtgagcccccctgtgggtcccgcggagtgccgcgccctgcgcccgctgcccactctcacgcgtgaagtcgtgaagagaagccttcccagcatcagtaaaggcagcgccggcgccgtgttagttgagagcacacacagttgagtctttgcgggcttgtttttttctcttctattttttcttttcttggcagccttgagaacgtgcagtgagagcttgaggaagaaggcctgacttgctgctgcggaattaggagggaaaagtgtatgcgttaaaaggggaaaggctcgttggtggagctttgaaaggtcagattttggctttccctctaatgaaggaaaagggtttttgaacagtgccacctgtcactcctcctaggtagtgttgaggaaacctcttgagtgctttcctacccggtaaattagatatttctaatgtctgaggagagcgaagggagaaatgagaacctaggaacactcggcattccatcgttttacaccgaatgcccgcttggaagaactgctgcgagaagtcttggaataccattgtgttgaaagcgccaggagcctgagtcgccgatggagacgagatagtagccggctaagagcagggcctgagttcagacccggcctctctgcttgttagctctttgaccttgttcctctctctgtctctg

SEQ ID NO: 302144 - DNA, 714 bp, Homo sapiens
  misc_feature (24)..(24): n is a, c, g, or t
  misc_feature (29)..(29): n is a, c, g, or t
  misc_feature (43)..(43): n is a, c, g, or t
  misc_feature (50)..(50): n is a, c, g, or t
  misc_feature (55)..(55): n is a, c, g, or t
gatacattcacccggaacagtttnccatnttccgattaatccncctcatntaggnaatttgccttcgagccaagattcggcacgaggactttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagt

SEQ ID NO: 302145 - DNA, 834 bp, Homo sapiens
gtggcgagattccgcggcggaaatcgacgttctagctttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggtgagctatgcccgtggtcctcagggccgggacccgggcccagcccaggctcctttcgatgtactgtctttcgttagcgtccccgacccgcgctcgcgggcctgtagggctctccgacagggcgtgctaccggagttggcctgaaaccagtcctcgctttgttttctggctcctcctctcccgcctctcccgctgtctccgccctgttctattttccctaagaatgtctgaactgggagggataccctagcgcccttgttttaccagtgagaaaactgaggcctttaagaattaagtgacttgtccaaggtcactatccgtattttaggagccaagacgagatcaagttcaatattccaggagtggtactgactagaccttgtagttattttgaaaatgttagcctccaattacaaaagcaagcatttcctagttctcactcaacttctccttttccctgttcctctcaaaaaagaaaaaaaaaatcaactctggtaactcattgccagtctgaattttcaataggccagatggaagacaacaaaagtaatctcaagttagtgacagattaggtgggaaaacgttagtttacgccaagttttatttaatttaaacttttaagtggctttaacgctttcaaaacctaactttcctcttctttcaac

SEQ ID NO: 302146 - DNA, 386 bp, Homo sapiens
ccaaagtgctgggattacaggtgtgacccactgtgcccggcctggtaattttatttttttactaatagtatttaatctttttttgatgtttagtatgtatgacttctcccaatttttggatgcagtctctgcagaagtgatcggcagttatgttcagttttggagctcctagggtcaaagtacttgagttcaaattttgcctttccactttctatctctgtgcctcagtttcctcatcagtaaaatacagattattttattaatataaatatgtaacaatacgttctgggaattaaatgtgattgtttaataaagagtaatgatattattaacacacttgaaatgtatcaccccttcagttaatagaatggtaaacatgttaggat

SEQ ID NO: 302147 - DNA, 288 bp, Homo sapiens
ggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgtcactgtcaggtaccaggctctgccttttggagtgatttcagccaccaagtcatcaacagtaacggtcgagcggccgcgaatttagtagtagtagtcgtcggcggccgc

SEQ ID NO: 302148 - DNA, 2997 bp, Homo sapiens
  misc_feature (24)..(24): n is a, c, g, or t
  misc_feature (29)..(29): n is a, c, g, or t
  misc_feature (43)..(43): n is a, c, g, or t
  misc_feature (50)..(50): n is a, c, g, or t
  misc_feature (55)..(55): n is a, c, g, or t
gatacattcacccggaacagtttnccatnttccgattaatccncctcatntaggnaatttgccttcgagccaagattcggcacgaggactttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtttgcttggattttgaaatgaatgggactttgtctttattactaattcaccaaatttgttgagcgcaaaagcaattaatgtagtttaagtatttagtatgtacagttctctgtgttaacagctgagaagtaagcaaccttttctgactgcatatggtgtattcctcttttgagtccccataatattttataaattgtaatgccccatcttgtactacagttgtcttattcgtattgtttataaactttgagggttaggactgggtcttactcatctttatgtgccttccttatgcttcaaagaatttaccatctaatggaagagaacatttgcaagttggctccataccaagctccttccacatactctactcatctgaactttgaatgcagaatctttaaattgcaaccccacatactaaggtcaagaaagaacttaatgggaattaatctccacccattagctttaccctgacatcaggattgccaaatccaatggactcttgtctattcttacgtgacttctgctggaaaatgcgaatgttgaccatcctgccacttggaactctcttcccactcctcacattgcttttgctaccactggaagttccttctgtttcttgtggagtaccttttgctgtctgggacttgtagataatggtgtttcctagggctccctccagggccctctgcctcactaactggatatacttttcctgagcaaatcccaggaaacttgcgtcagaccgtgacttcaaatacaggttgataaatgctaaactgtctccaaaccagacttcatcctagcctccacacccagacacccaactgctatggatcaactttttagaatatcctcacttcaaactgaccttacctaaaataatgactttttcccccaataattgcccctgctatattccttatttctgaatggtacctcctagctatatagattatctgaggagcttactgaaatgctgattctgaagataaggggcatggctttaagattctgtatttctggcgagtacccaactggtgctcatgctgctgattgagaaccacttctgaatatagcaaggctgtaaattatccactacgtgccctcgtaattgtcttagttcaagcccagattattgtagtagacttagtatttctttgccttagttgatctgtgacccctccaatatctattccacactgttgcctaagtggccttagtaaaattcaagtctggttattttattcccctgcttggaatttctcaatgtagaatgaaactcattcagcattaacacataggcccttcttgatctgacatcgtgtttctctagttagactaaagaatccccactatgaagttgtttcatccgtaagtacctttgaacccagaagccccctttctcatatgtttctcattcctgtttgcccttcagagttcagctttagttgctaaaacattcagacatccctctgacttagatcccccactactgtttttctgtgagaagcagctatgcataattcctcttcaacacagtagttcttgaaattttgcaggcctctcctggaaaggaggaaatgacttctctgactttgtatgatgcttatttgtggatgaatgggcaagggaaaaaatgaaggaacaagtgaatgaacagtatgggagtatgagaaaaggtataaattgggtatagttgagaaaaggattcaaattgatctttggttcgagagacaatttcatctttctgatgaatttaaagtgtagtctttgaaccagctgggcttaattatgtaaagttttgagcctgagataagcacacaatcacaaaacctacccaaacaagttttttgtttcacttcatctcttataaaacaatgttctaaagtaagtgatagggatgctcatcattctgctacctattatcacaatgaaaacaatcataaatagtacacaggaaaggtgagaaatagcggatagttcttatttcatagtactgtatatggaaataaaccaaatttgctcatagagatactattttattacctcaaaaatatataaaaatgaaaacgttatgaaaatattttaaaatgggatttaaaaataattgagaacatcacagcaatttagaatactaaagagcatagctttaaaatgatagtgctgagaactccccacctctaccccaccacctgtaggcttctttgacaacttacaaatgttctctagtttgtatctagaatcacttatatctttcaaataaaccaactttgtgaacaaa

SEQ ID NO: 302149 - DNA, 589 bp, Homo sapiens
gtggcgagattccgcggcggaaatcgacgttctagctttctgtgtgcttaggtgcccgagctactgagggtctaagtccgggcagccgaagagtgtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagt

SEQ ID NO: 302150 - DNA, 2814 bp, Homo sapiens
cttttggggtctttgctttatactaaccaaattattattcaagtatgaaggtaaaagaaagatgaaatggatgtgcaatgactcaaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtttgcttggattttgaaatgaatgggactttgtctttattactaattcaccaaatttgttgagcgcaaaagcaattaatgtagtttaagtatttagtatgtacagttctctgtgttaacagctgagaagtaagcaaccttttctgactgcatatggtgtattcctcttttgagtccccataatattttataaattgtaatgccccatcttgtactacagttgtcttattcgtattgtttataaactttgagggttaggactgggtcttactcatctttatgtgccttccttatgcttcaaagaatttaccatctaatggaagagaacatttgcaagttggctccataccaagctccttccacatactctactcatctgaactttgaatgcagaatctttaaattgcaaccccacatactaaggtcaagaaagaacttaatgggaattaatctccacccattagctttaccctgacatcaggattgccaaatccaatggactcttgtctattcttacgtgacttctgctggaaaatgcgaatgttgaccatcctgccacttggaactctcttcccactcctcacattgcttttgctaccactggaagttccttctgtttcttgtggagtaccttttgctgtctgggacttgtagataatggtgtttcctagggctccctccagggccctctgcctcactaactggatatacttttcctgagcaaatcccaggaaacttgcgtcagaccgtgacttcaaatacaggttgataaatgctaaactgtctccaaaccagacttcatcctagcctccacacccagacacccaactgctatggatcaactttttagaatatcctcacttcaaactgaccttacctaaaataatgactttttcccccaataattgcccctgctatattccttatttctgaatggtacctcctagctatatagattatctgaggagcttactgaaatgctgattctgaagataaggggcatggctttaagattctgtatttctggcgagtacccaactggtgctcatgctgctgattgagaaccacttctgaatatagcaaggctgtaaattatccactacgtgccctcgtaattgtcttagttcaagcccagattattgtagtagacttagtatttctttgccttagttgatctgtgacccctccaatatctattccacactgttgcctaagtggccttagtaaaattcaagtctggttattttattcccctgcttggaatttctcaatgtagaatgaaactcattcagcattaacacataggcccttcttgatctgacatcgtgtttctctagttagactaaagaatccccactatgaagttgtttcatccgtaagtacctttgaacccagaagccccctttctcatatgtttctcattcctgtttgcccttcagagttcagctttagttgctaaaacattcagacatccctctgacttagatcccccactactgtttttctgtgagaagcagctatgcataattcctcttcaacacagtagttcttgaaattttgcaggcctctcctggaaaggaggaaatgacttctctgactttgtatgatgcttatttgtggatgaatgggcaagggaaaaaatgaaggaacaagtgaatgaacagtatgggagtatgagaaaaggtataaattgggtatagttgagaaaaggattcaaattgatctttggttcgagagacaatttcatctttctgatgaatttaaagtgtagtctttgaaccagctgggcttaattatgtaaagttttgagcctgagataagcacacaatcacaaaacctacccaaacaagttttttgtttcacttcatctcttataaaacaatgttctaaagtaagtgatagggatgctcatcattctgctacctattatcacaatgaaaacaatcataaatagtacacaggaaaggtgagaaatagcggatagttcttatttcatagtactgtatatggaaataaaccaaatttgctcatagagatactattttattacctcaaaaatatataaaaatgaaaacgttatgaaaatattttaaaatgggatttaaaaataattgagaacatcacagcaatttagaatactaaagagcatagctttaaaatgatagtgctgagaactccccacctctaccccaccacctgtaggcttctttgacaacttacaaatgttctctagtttgtatctagaatcacttatatctttcaaataaaccaactttgtgaacaaa

SEQ ID NO: 302151 - DNA, 2951 bp, Homo sapiens
  misc_feature (24)..(24): n is a, c, g, or t
  misc_feature (29)..(29): n is a, c, g, or t
  misc_feature (43)..(43): n is a, c, g, or t
  misc_feature (50)..(50): n is a, c, g, or t
  misc_feature (55)..(55): n is a, c, g, or t
gatacattcacccggaacagtttnccatnttccgattaatccncctcatntaggnaatttgccttcgagccaagattcggcacgaggactttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtttgcttggattttgaaatgaatgggactttgtctttattactaattcaccaaatttgttgagcgcaaaagcaattaatgtagtttaagtatttagtatgtacagttctctgtgttaacagctgagaagtaagcaaccttttctgactgcatatggtgtattcctcttttgagtccccataatattttataaattgtaatgccccatcttgtactacagttgtcttattcgtattgtttataaactttgagggttaggactgggtcttactcatctttatgtgccttccttatgcttcaaagaatttaccatctaatggaagagaacatttgcaagttggctccataccaagctccttccacatactctactcatctgaactttgaatgcagaatctttaaattgcaaccccacatactaaggtcaagaaagaacttaatgggaattaatctccacccattagctttaccctgacatcaggattgccaaatccaatggactcttgtctattcttacgtgacttctgctggaaaatgcgaatgttgaccatcctgccacttggaactctcttcccactcctcacattgcttttgctaccactggaagttccttctgtttcttgtggagtaccttttgctgtctgggacttgtagataatggtgtttcctagggctccctccagggccctctgcctcactaactggatatacttttcctgagcaaatcccaggaaacttgcgtcagaccgtgacttcaaatacaggttgataaatgctaaactgtctccaaaccagacttcatcctagcctccacacccagacacccaactgctatggatcaactttttagaatatcctcacttcaaactgaccttacctaaaataatgactttttcccccaataattgcccctgctatattccttatttctgaatggtacctcctagctatatagattatctgaggagcttactgaaatgctgattctgaagataaggggcatggctttaagattctgtatttctggcgagtacccaactggtgctcatgctgctgattgagaaccacttctgaatatagcaaggctgtaaattatccactacgtgccctcgtaattgtcttagttcaagcccagattattgtagtagacttagtatttctttgccttagttgatctgtgacccctccaatatctattccacactgttgcctaagtggccttagtaaaattcaagtctggttattttattcccctgcttggaatttctcaatgtagaatgaaactcattcagcattaacacataggcccttcttgatctgacatcgtgtttctctagttagactaaagaatccccactatgaagttgtttcatccgtaagtacctttgaacccagaagccccctttctcatatgtttctcattcctgtttgcccttcagagttcagctttagttgctaaaacattcagacatccctctgacttagatcccccactactgtttttctgtgagaagcagctatgcataattcctcttcaacacagtagttcttgaaattttgcaggcctctcctggaaaggaggaaatgacttctctgactttgtatgatgcttatttgtggatgaatgggcaagggaaaaaatgaaggaacaagtgaatgaacagtatgggagtatgagaaaaggtataaattgggtatagttgagaaaaggattcaaattgatctttggttcgagagacaatttcatctttctgatgaatttaaagtgtagtctttgaaccagctgggcttaattatgtaaagttttgagcctgagataagcacacaatcacaaaacctacccaaacaagttttttgtttcacttcatctcttataaaacaatgttctaaagtaagtgatagggatgctcatcattctgctacctattatcacaatgaaaacaatcataaatagtacacaggaaaggtgagaaatagcggatagttcttatttcatagtactgtatatggaaataaaccaaatttgctcatagagatactattttattacctcaaaaatatataaaaatgaaaacgttatgaaaatattttaaaatgggatttaaaaataattgagaacatcacagcaatttagaatactaaagagcatagctttaaaatgatagtgctgagaactccccacctctaccccaccacctgtaggcttctttgacaacttacaaatgttctctagtttgtatctagaatcacttatatctttcaaataaaccaactttgtgaacaaa

SEQ ID NO: 302152 - DNA, 3042 bp, Homo sapiens
  misc_feature (24)..(24): n is a, c, g, or t
  misc_feature (29)..(29): n is a, c, g, or t
  misc_feature (43)..(43): n is a, c, g, or t
  misc_feature (50)..(50): n is a, c, g, or t
  misc_feature (55)..(55): n is a, c, g, or t
gatacattcacccggaacagtttnccatnttccgattaatccncctcatntaggnaatttgccttcgagccaagattcggcacgaggactttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagataatgattttaaatgatatgatttgttttttgcttttgcataagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtttgcttggattttgaaatgaatgggactttgtctttattactaattcaccaaatttgttgagcgcaaaagcaattaatgtagtttaagtatttagtatgtacagttctctgtgttaacagctgagaagtaagcaaccttttctgactgcatatggtgtattcctcttttgagtccccataatattttataaattgtaatgccccatcttgtactacagttgtcttattcgtattgtttataaactttgagggttaggactgggtcttactcatctttatgtgccttccttatgcttcaaagaatttaccatctaatggaagagaacatttgcaagttggctccataccaagctccttccacatactctactcatctgaactttgaatgcagaatctttaaattgcaaccccacatactaaggtcaagaaagaacttaatgggaattaatctccacccattagctttaccctgacatcaggattgccaaatccaatggactcttgtctattcttacgtgacttctgctggaaaatgcgaatgttgaccatcctgccacttggaactctcttcccactcctcacattgcttttgctaccactggaagttccttctgtttcttgtggagtaccttttgctgtctgggacttgtagataatggtgtttcctagggctccctccagggccctctgcctcactaactggatatacttttcctgagcaaatcccaggaaacttgcgtcagaccgtgacttcaaatacaggttgataaatgctaaactgtctccaaaccagacttcatcctagcctccacacccagacacccaactgctatggatcaactttttagaatatcctcacttcaaactgaccttacctaaaataatgactttttcccccaataattgcccctgctatattccttatttctgaatggtacctcctagctatatagattatctgaggagcttactgaaatgctgattctgaagataaggggcatggctttaagattctgtatttctggcgagtacccaactggtgctcatgctgctgattgagaaccacttctgaatatagcaaggctgtaaattatccactacgtgccctcgtaattgtcttagttcaagcccagattattgtagtagacttagtatttctttgccttagttgatctgtgacccctccaatatctattccacactgttgcctaagtggccttagtaaaattcaagtctggttattttattcccctgcttggaatttctcaatgtagaatgaaactcattcagcattaacacataggcccttcttgatctgacatcgtgtttctctagttagactaaagaatccccactatgaagttgtttcatccgtaagtacctttgaacccagaagccccctttctcatatgtttctcattcctgtttgcccttcagagttcagctttagttgctaaaacattcagacatccctctgacttagatcccccactactgtttttctgtgagaagcagctatgcataattcctcttcaacacagtagttcttgaaattttgcaggcctctcctggaaaggaggaaatgacttctctgactttgtatgatgcttatttgtggatgaatgggcaagggaaaaaatgaaggaacaagtgaatgaacagtatgggagtatgagaaaaggtataaattgggtatagttgagaaaaggattcaaattgatctttggttcgagagacaatttcatctttctgatgaatttaaagtgtagtctttgaaccagctgggcttaattatgtaaagttttgagcctgagataagcacacaatcacaaaacctacccaaacaagttttttgtttcacttcatctcttataaaacaatgttctaaagtaagtgatagggatgctcatcattctgctacctattatcacaatgaaaacaatcataaatagtacacaggaaaggtgagaaatagcggatagttcttatttcatagtactgtatatggaaataaaccaaatttgctcatagagatactattttattacctcaaaaatatataaaaatgaaaacgttatgaaaatattttaaaatgggatttaaaaataattgagaacatcacagcaatttagaatactaaagagcatagctttaaaatgatagtgctgagaactccccacctctaccccaccacctgtaggcttctttgacaacttacaaatgttctctagtttgtatctagaatcacttatatctttcaaataaaccaactttgtgaacaaa

SEQ ID NO: 302153 - DNA, 743 bp, Homo sapiens
  misc_feature (24)..(24): n is a, c, g, or t
  misc_feature (29)..(29): n is a, c, g, or t
  misc_feature (43)..(43): n is a, c, g, or t
  misc_feature (50)..(50): n is a, c, g, or t
  misc_feature (55)..(55): n is a, c, g, or t
gatacattcacccggaacagtttnccatnttccgattaatccncctcatntaggnaatttgccttcgagccaagattcggcacgaggactttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtaaccaaaagaacgcgaccacacgcgcaac

SEQ ID NO: 302154 - DNA, 881 bp, Homo sapiens
  misc_feature (24)..(24): n is a, c, g, or t
  misc_feature (29)..(29): n is a, c, g, or t
  misc_feature (43)..(43): n is a, c, g, or t
  misc_feature (50)..(50): n is a, c, g, or t
  misc_feature (55)..(55): n is a, c, g, or t
gatacattcacccggaacagtttnccatnttccgattaatccncctcatntaggnaatttgccttcgagccaagattcggcacgaggactttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtgagaaaaaaaaaaaaaaaaaaaaaaaaatttccggggcttttttttccggggccgggaaaaaggggtttaaatggggcagtgggcttagcgttcctggcccgttttttgtcacgggggaaatccggggtcccaaaaggggcgataatcataagccgacgagttggag

SEQ ID NO: 302155 - DNA, 1151 bp, Homo sapiens
  misc_feature (24)..(24): n is a, c, g, or t
  misc_feature (29)..(29): n is a, c, g, or t
  misc_feature (43)..(43): n is a, c, g, or t
  misc_feature (50)..(50): n is a, c, g, or t
  misc_feature (55)..(55): n is a, c, g, or t
  misc_feature (720)..(720): n is a, c, g, or t
  misc_feature (921)..(921): n is a, c, g, or t
gatacattcacccggaacagtttnccatnttccgattaatccncctcatntaggnaatttgccttcgagccaagattcggcacgaggactttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtaaaaanaaacaacaaaaaactccggggcaccaatgtccgggggcggcgcaacgcagctcctgaacggccccatggccatagcggtcccagacccagctttctggtccacccgcggacatctgccggtccccccctataaggggagtccgcaatcacatccgaataaggcccaggtttaccctggccattaagaactctcgcgaaaancccgggaaaccaccaggccagcacgagcgccaagcggcacccaggcaccccccctgcaccaccacacgcaacgcacgcaccaacgactccgacatccacgaccccaaccacacccaccagcaccgcacgacgcacagcacaaccccccccaccaccacgccccagcacgcacagccgccccacgacgcagcacatcatccgccacacgcgcacctcaacacgatccgcgg

SEQ ID NO: 302156 - DNA, 531 bp, Homo sapiens
cttttggggtctttgctttatactaaccaaattattattcaagtatgaaggtaaaagaaagatgaaatggatgtgcaatgactcaaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagt

SEQ ID NO: 302157 - DNA, 1026 bp, Homo sapiens
  misc_feature (595)..(595): n is a, c, g, or t
  misc_feature (796)..(796): n is a, c, g, or t
gtggcgagattccgcggcggaaatcgacgttctagctttctgtgtgcttaggtgcccgagctactgagggtctaagtccgggcagccgaagagtgtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtaaaaanaaacaacaaaaaactccggggcaccaatgtccgggggcggcgcaacgcagctcctgaacggccccatggccatagcggtcccagacccagctttctggtccacccgcggacatctgccggtccccccctataaggggagtccgcaatcacatccgaataaggcccaggtttaccctggccattaagaactctcgcgaaaancccgggaaaccaccaggccagcacgagcgccaagcggcacccaggcaccccccctgcaccaccacacgcaacgcacgcaccaacgactccgacatccacgaccccaaccacacccaccagcaccgcacgacgcacagcacaaccccccccaccaccacgccccagcacgcacagccgccccacgacgcagcacatcatccgccacacgcgcacctcaacacgatccgcgg

SEQ ID NO: 302158 - DNA, 664 bp, Homo sapiens
  misc_feature (24)..(24): n is a, c, g, or t
  misc_feature (29)..(29): n is a, c, g, or t
  misc_feature (43)..(43): n is a, c, g, or t
  misc_feature (50)..(50): n is a, c, g, or t
  misc_feature (55)..(55): n is a, c, g, or t
gatacattcacccggaacagtttnccatnttccgattaatccncctcatntaggnaatttgccttcgagccaagattcggcacgaggactttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaataatgatgtatacattgtattgatttttttccctaaatgtgttattttaataaatatctcatgaatgagtttgaagt

SEQ ID NO: 302159 - DNA, 539 bp, Homo sapiens
gtggcgagattccgcggcggaaatcgacgttctagctttctgtgtgcttaggtgcccgagctactgagggtctaagtccgggcagccgaagagtgtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaataatgatgtatacattgtattgatttttttccctaaatgtgttattttaataaatatctcatgaatgagtttgaagt

SEQ ID NO: 302160 - DNA, 490 bp, Homo sapiens
tagtatttaatctttttttgatgtttagtatgtatgacttctcccaatttttggatgcagtctctgcagaagtgatcggcagttatgttcagttttggagctcctagggtcaaagtacttgagttcaaattttgcctttccactttctatctctgtgcctcagtttcctcatcagtaaaatacagattattttattaatataaatatgtaacaatacgttctgggaattaaatgtgatgtttaaaaaaaagcaaacccacactgcattagcccagtgccaagcacataagtgtttaataaagagtaatgatattattaacacacttgaaatgtatcaccccttcagttaatagaatggtaaacatgttaggatgcctgcctagaggatttagcagaaaatgctttgtaaatgttctatatctgaaagtacatgttgatgtccaggttagcaagatgaacaaagatgcgcagatgagagcagcgattaacc

SEQ ID NO: 302161 - DNA, 507 bp, Homo sapiens
aagaattttctcacgttttcttctcatcaacatgcagtgcatttaggcattggatagttcatttaaaatgatgaattgcaagaagacacttttctttgtcagataactttaccttttttttaattgaacatgagggttatttatgaaattcttatgttgtttaccctgagcaaaatgtcagatcttaaattctcatgtattaattggtaccttcttactcttatttttttatttttgtttttcagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagt

SEQ ID NO: 302162 - DNA, 952 bp, Homo sapiens
cggccgctccttggtcgcggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacaggtgagcgaagcgcggcttgtagccttttccctctctcggggggacgagtggggcaccacctccgcgcggggctccccgctgggccaccccttcgccagcgcccagccccgtgcggcctgtcggatcaggcagggcagagtcggtctcggcgctgtccccgcccctggggtcggaagcgaccggggctggccgggcctggtctctggtgtctccggccgggcctcggttcccctcctcccccggcttcccccggccgggccgagctcccctcgcgcgcccattgtgaggtcacgtcctgcaggcgcgccctggcacccgggccaagacgcccggagcggctgctgcagccagtagcggccccttcaccggctgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttgggtaaagggccaagagggaagggcgaggcggggaggaagcagctcgggccgccttccctccgtggcctccaggacatccgccggggatagattatgcgtttccattggttacccaccttgagcgagccgtttgatagaaaccaagagcttgaaacgtgcattaggccattgtggactcccagtgggaggcgagtgaatgaattattcatagttaaaaaaat

SEQ ID NO: 302163 - DNA, 4307 bp, Homo sapiens
cggccgctccttggtcgcggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgcca

SEQ ID NO: 302164 - DNA, 4823 bp, Homo sapiens
cggccgctccttggtcgcggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacaggtgagcgaagcgcggcttgtagccttttccctctctcggggggacgagtggggcaccacctccgcgcggggctccccgctgggccaccccttcgccagcgcccagccccgtgcggcctgtcggatcaggcagggcagagtcggtctcggcgctgtccccgcccctggggtcggaagcgaccggggctggccgggcctggtctctggtgtctccggccgggcctcggttcccctcctcccccggcttcccccggccgggccgagctcccctcgcgcgcccattgtgaggtcacgtcctgcaggcgcgccctggcacccgggccaagacgcccggagcggctgctgcagccagtagcggccccttcaccggctgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttggtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgcca

SEQ ID NO: 302165 - DNA, 5010 bp, Homo sapiens
cggccgctccttggtcgcggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacaggtgagcgaagcgcggcttgtagccttttccctctctcggggggacgagtggggcaccacctccgcgcggggctccccgctgggccaccccttcgccagcgcccagccccgtgcggcctgtcggatcaggcagggcagagtcggtctcggcgctgtccccgcccctggggtcggaagcgaccggggctggccgggcctggtctctggtgtctccggccgggcctcggttcccctcctcccccggcttcccccggccgggccgagctcccctcgcgcgcccattgtgaggtcacgtcctgcaggcgcgccctggcacccgggccaagacgcccggagcggctgctgcagccagtagcggccccttcaccggctgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttgggtaaagggccaagagggaagggcgaggcggggaggaagcagctcgggccgccttccctccgtggcctccaggacatccgccggggatagattatgcgtttccattggttacccaccttgagcgagccgtttgatagaaaccaagagcttgaaacgtgcattaggccattgtggactcccagtgggagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgcca

SEQ ID NO: 302166 - DNA, 4170 bp, Homo sapiens
  misc_feature (65)..(65): n is a, c, g, or t
  misc_feature (67)..(67): n is a, c, g, or t
  misc_feature (74)..(75): n is a, c, g, or t
tcatagccgactccagaggatacaccctggtcccgcctaacaatcgtcgtcgcatctggcgatgncncgggcgnnacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgcca

SEQ ID NO: 302167 - DNA, 5510 bp, Homo sapiens
cggccgctccttggtcgcggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacaggtgagcgaagcgcggcttgtagccttttccctctctcggggggacgagtggggcaccacctccgcgcggggctccccgctgggccaccccttcgccagcgcccagccccgtgcggcctgtcggatcaggcagggcagagtcggtctcggcgctgtccccgcccctggggtcggaagcgaccggggctggccgggcctggtctctggtgtctccggccgggcctcggttcccctcctcccccggcttcccccggccgggccgagctcccctcgcgcgcccattgtgaggtcacgtcctgcaggcgcgccctggcacccgggccaagacgcccggagcggctgctgcagccagtagcggccccttcaccggctgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttggtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgccaaaaatggctgggaacgtttgctttatttacattcagtcagcgttgctttcagatcacactttatccacacaggaaagccagtcagcctataatgaagtagttattaaaataaatgtaatgaatatgtctacaaagtatagtttagtggtttattttgctaaaatgcacatatatttgatataatttagtttgagaagttcagctagtttttctcctttgtttgactttgtcaatttctatctggtttttaagggtctgagcttagcttgtgcatgcaaggttttgggtttttttattttttttttgagcacagcttttcaccttttaatttgttgggtatttttctcttaataagagaaatattggccatcgatttttacatataatacaagtgtgtttttccagtacattggttcctgtcccctctctgtgaactgtttgagtattggaacagtatgtcttcaataattcaatgttactttgagatacatgtgttaatatacccttagttattcttgaaataaaaccagtctcttacgcttgcagtggagaaaggctgtgagtctgaggtgtgtgttctctatatattatcaccttcatgaactgtctgacctgggtgcggagcccttttttttttttttttttgagacggagtctggctctgtcacccaggttggagtgcaatag

SEQ ID NO: 302168 - DNA, 4218 bp, Homo sapiens
cggccgctccttggtcgcggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgccaaaaatggctgggaacgtttgctttatttacattcagtcagcgttgctttcagatcacactttatccacacaggaaagccagtcagcctataatgaagtagttattaaaataaatgtaatgaatatgtctacaaagtatagtttagtggtttattttgctaaaatgcacatatatttgatataatttagtttgagaagttcagctagtttttctcctttgtttgactttgtcaatttctatctggtttttaagggtctgagcttagcttgtgcatgcaaggttttgggtttttttattttttttttgagcacagcttttcaccttttaatttgttgggtatttttctcttaataagagaaatattggccatcgatttttacatataatacaagtgtgtttttccagtacattggttcctgtcccctctctgtgaactgtttgagtattggaacagtatgtcttcaataattcaatgttactttgagatacatgtgttaatatacccttagttattcttgaaataaaaccagtctcttacgcttgcagtggagaaaggctgtgagtctgaggtgtgtgttctctatatattatcaccttcatgaactgtctgacctgggtgcggagcccttttttttttttttttttgagacggagtctggctctgtcacccaggttggagtgcaatag

SEQ ID NO: 302169 - DNA, 4104 bp, Homo sapiens
cggccgctccttggtcgcggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacaggtgagcgaagcgcggcttgtagccttttccctctctcggggggacgagtggggcaccacctccgcgcggggctccccgctgggccaccccttcgccagcgcccagccccgtgcggcctgtcggatcaggcagggcagagtcggtctcggcgctgtccccgcccctggggtcggaagcgaccggggctggccgggcctggtctctggtgtctccggccgggcctcggttcccctcctcccccggcttcccccggccgggccgagctcccctcgcgcgcccattgtgaggtcacgtcctgcaggcgcgccctggcacccgggccaagacgcccggagcggctgctgcagccagtagcggccccttcaccggctgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttggtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagctactcgggaggctgaggccgagattgcaccattgcgctccagcctgggcaacaagagtgaaactccatctc

SEQ ID NO: 302170 - DNA, 2912 bp, Homo sapiens
cggccgctccttggtcgcggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacaggtgagcgaagcgcggcttgtagccttttccctctctcggggggacgagtggggcaccacctccgcgcggggctccccgctgggccaccccttcgccagcgcccagccccgtgcggcctgtcggatcaggcagggcagagtcggtctcggcgctgtccccgcccctggggtcggaagcgaccggggctggccgggcctggtctctggtgtctccggccgggcctcggttcccctcctcccccggcttcccccggccgggccgagctcccctcgcgcgcccattgtgaggtcacgtcctgcaggcgcgccctggcacccgggccaagacgcccggagcggctgctgcagccagtagcggccccttcaccggctgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttggtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggccttta

SEQ ID NO: 302171 - DNA, 1205 bp, Homo sapiens
cggccgctccttggtcgcggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcataaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaagggggggggcggacataaaaaatccccggaggggagacccaatgaaagagagccagatgtgatgaacaaaggggcaccacgagaggggggagagaaagaggaggggagggggcgagaaaaggaagagagggggggagaaaaagaagagggaaaccgatgggggagaaaagtggggggggaaaaggagagagaagacga

SEQ ID NO: 302172 - DNA, 3674 bp, Homo sapiens
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacagatttgagttctgtgaacctgcatttgttgttggtaattgcctccagatagcttctgacagtcatcagtatgatcgaatttattgtggagctggagtacagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaataactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctgggtcagcggatgcactttagcagatggaacttctagtttatctgaatatttatctttgacaaggtagggctgagcctacatttgcttttgatctatctagtataagaaatattcacagaaattgtatgtagataccctttgttttgaaaatgctgttcagaatcatagtgtaatctttgggacctatgccatgttcatttcactccttcccatattttttgtgtttcttttggtaaaactataatggttttcattttttacttaatatcacacagttaaactgtccatatttgagctttattttagcttatcagtgataaaaaacaggtagtaactgccattgtttgtttgttttcctaataaggcctgaaaacagccattccttgttaagaaagtgtacaatgtaacatatttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttataccagtggctgggatggtggaattggggttatttctacaattattcttagacgattactaaactgttaagaaatgccccatatcatttttgtatctaggaaagaaaaaaatcagtttcatactgttgtcatctgtcagaaatgctcattttattttgaattaaatgtggcttttgaagtacctagttaccttgaattcctggtgaccacatgtttttatctggaaaacctggagaaagttatctgtcccatctcccctgcttgttttttttttttttttttgggttggagctgctgtttagatgatgcttttactatgcaggagagagtttttgttaaggatatatttgaagattggcttttccatattgtccttcattctttgaccgtggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacaataagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaaaaa

SEQ ID NO: 302173 - DNA, 1430 bp, Homo sapiens
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataagaggcgatcccgcgccctgggtgcggtgaggccgctgggacagcggaggtgcctcccgacgcgaagcagcgagctgaggcggcggccagcggggaagatgagcggcagcagcgccaggtccagccacctgtctcagcccgtcgtgaagagcgtgcttgtgtaccgcaacggggaccccttctacgcggggcgccgcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaagtgagtcggtctcccccaccgcccacccatttaggtgccctatagtgtggggttgatatgaagaaatgcagatccctacccccccacacctcagtggttgaggggctgtgacttctcggtgtgattgatgcccctcaaaactctcgttgcagttggggggtagaggttgacactgtgactggagaaggaatttcacttgggtcagcagtaggagtaaacttaaaatctgtgtataaacaacaggaatcttaaagaaaataaaaaggtatccttgcaaaggttagtgacc

SEQ ID NO: 302174 - DNA, 948 bp, Homo sapiens
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtaccaggacccaatgctaataaagactggactgtgaaaaaaaaaaaaaaaaaaaaaaaaaaataaaagaaacaaaaaaaaaaaaaaacaaaaaaaacaaacacaaaaacacggacaaaaaccaaaaaagaacgacaaagaagagcagggggggcggcgcgccccatacaaattcgcccggcagggggcgcccgcatttgacgacagccacccgactgtttgtggtgaaagcggcgcccacactaacaggatggcgcgtcaaatacgacgcacgcgcgcgcgcttttcacatcccgtctg

SEQ ID NO: 302175 - DNA, 877 bp, Homo sapiens
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataagtaagtattcatatctatagttttggtttaaaatcacttaatagatacatgcaacatgtctattcttgaacactattattgatcctgactggctcaattgaatgcagcaaaaatcagtgcaccata

SEQ ID NO: 302176 - DNA, 906 bp, Homo sapiens
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataattattaatagatttcacctattaatacatgaagacacagataatcccattgagggtcataaattgagcagaacagactcagggaagactcttgaatcagttgacagcaactctgtgcaagtgtctgtggagctcaagctatattgctggccacga

SEQ ID NO: 302177 - DNA, 4179 bp, Homo sapiens
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtacagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaataactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctgggtcagcggatgcactttagcagatggaacttctagtttatctgaatatttatctttgacaaggtagggctgagcctacatttgcttttgatctatctagtataagaaatattcacagaaattgtatgtagataccctttgttttgaaaatgctgttcagaatcatagtgtaatctttgggacctatgccatgttcatttcactccttcccatattttttgtgtttcttttggtaaaactataatggttttcattttttacttaatatcacacagttaaactgtccatatttgagctttattttagcttatcagtgataaaaaacaggtagtaactgccattgtttgtttgttttcctaataaggcctgaaaacagccattccttgttaagaaagtgtacaatgtaacatatttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttataccagtggctgggatggtggaattggggttatttctacaattattcttagacgattactaaactgttaagaaatgccccatatcatttttgtatctaggaaagaaaaaaatcagtttcatactgttgtcatctgtcagaaatgctcattttattttgaattaaatgtggcttttgaagtacctagttaccttgaattcctggtgaccacatgtttttatctggaaaacctggagaaagttatctgtcccatctcccctgcttgttttttttttttttttttgggttggagctgctgtttagatgatgcttttactatgcaggagagagtttttgttaaggatatatttgaagattggcttttccatattgtccttcattctttgaccgtggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacaataagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaaaaa

SEQ ID NO: 302178 - DNA, 3775 bp, Homo sapiens
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacagccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtacagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaataactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctgggtcagcggatgcactttagcagatggaacttctagtttatctgaatatttatctttgacaaggtagggctgagcctacatttgcttttgatctatctagtataagaaatattcacagaaattgtatgtagataccctttgttttgaaaatgctgttcagaatcatagtgtaatctttgggacctatgccatgttcatttcactccttcccatattttttgtgtttcttttggtaaaactataatggttttcattttttacttaatatcacacagttaaactgtccatatttgagctttattttagcttatcagtgataaaaaacaggtagtaactgccattgtttgtttgttttcctaataaggcctgaaaacagccattccttgttaagaaagtgtacaatgtaacatatttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttataccagtggctgggatggtggaattggggttatttctacaattattcttagacgattactaaactgttaagaaatgccccatatcatttttgtatctaggaaagaaaaaaatcagtttcatactgttgtcatctgtcagaaatgctcattttattttgaattaaatgtggcttttgaagtacctagttaccttgaattcctggtgaccacatgtttttatctggaaaacctggagaaagttatctgtcccatctcccctgcttgttttttttttttttttttgggttggagctgctgtttagatgatgcttttactatgcaggagagagtttttgttaaggatatatttgaagattggcttttccatattgtccttcattctttgaccgtggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacaataagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaaaaa

SEQ ID NO: 302179 - DNA, 4240 bp, Homo sapiens
  misc_feature (2534)..(2534): n is a, c, g, or t
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtacagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaataactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctgggtcagcgggatagcgattgtagcaagcatggcacactttctaagtattaatctcgaatcatttaatgctgtgtgcacaaagcgtcatgcggctagacgccgtacccatttttgcctttggtcgtatccttatcgtagcttattagatgaaatcattcctacaagcacatattagttattgtnagattacccttatgatttttggatagattgctgtctcagctcatagtgtaatctttgggacctatgccatgttcatttcactccttcccatattttttgtgtttcttttggtaaaactataatggttttcattttttacttaatatcacacagttaaactgtccatatttgagctttattttagcttatcagtgataaaaaacaggtagtaactgccattgtttgtttgttttcctaataaggcctgaaaacagccattccttgttaagaaagtgtacaatgtaacatatttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttataccagtggctgggatggtggaattggggttatttctacaattattcttagacgattactaaactgttaagaaatgccccatatcatttttgtatctaggaaagaaaaaaatcagtttcatactgttgtcatctgtcagaaatgctcattttattttgaattaaatgtggcttttgaagtacctagttaccttgaattcctggtgaccacatgtttttatctggaaaacctggagaaagttatctgtcccatctcccctgcttgttttttttttttttttttgggttggagctgctgtttagatgatgcttttactatgcaggagagagtttttgttaaggatatatttgaagattggcttttccatattgtccttcattctttgaccgtggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacaataagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaaaaa

SEQ ID NO: 302180 - DNA, 3660 bp, Homo sapiens
gatcacctgagcctgggtggttgaggctccagtaggccatgattgtgccatcacacttcagcctgggctgtagtgagaccttgtttcaaaacaaacaaacaaaaacttcataggggatgggatctcacatctgttgttatgaataagtagtacttttcatatgatttatacatcaaaaagtataaaagatacacaggatagtctctctcctggtcttgtctcctaattacttcacagtcatgtaccctgtttccaaattcttatgcttccagagaacttttatgcatataaatgccaacacacagacacacacacatgcccctgtacattttaacttcagtgccatccatcggtccttggcatataatgactactccaaaacctttgttagatgaaaggtagagttttcatattttctgtattttctaaaatatgctaagaaacacattttgttctatgaaaaaaataaacaatagataatgttttattgttaatattttctttcttgcgttttatgtttgtttttagctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaataactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctgggtcagcggatgcactttagcagatggaacttctagtttatctgaatatttatctttgacaaggtagggctgagcctacatttgcttttgatctatctagtataagaaatattcacagaaattgtatgtagataccctttgttttgaaaatgctgttcagaatcatagtgtaatctttgggacctatgccatgttcatttcactccttcccatattttttgtgtttcttttggtaaaactataatggttttcattttttacttaatatcacacagttaaactgtccatatttgagctttattttagcttatcagtgataaaaaacaggtagtaactgccattgtttgtttgttttcctaataaggcctgaaaacagccattccttgttaagaaagtgtacaatgtaacatatttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttataccagtggctgggatggtggaattggggttatttctacaattattcttagacgattactaaactgttaagaaatgccccatatcatttttgtatctaggaaagaaaaaaatcagtttcatactgttgtcatctgtcagaaatgctcattttattttgaattaaatgtggcttttgaagtacctagttaccttgaattcctggtgaccacatgtttttatctggaaaacctggagaaagttatctgtcccatctcccctgcttgttttttttttttttttttgggttggagctgctgtttagatgatgcttttactatgcaggagagagtttttgttaaggatatatttgaagattggcttttccatattgtccttcattctttgaccgtggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacaataagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaaaaa

SEQ ID NO: 302181 - DNA, 4125 bp, Homo sapiens
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtacagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaataactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctgggtcagcggatgcactttagcagatggaacttctagtttatctgaatatttatctttgacaaggtagggctgagcctacatttgcttttgatctatctagtataagaaatattcacagaaattgtatgtagataccctttgttttgaaaatgctgttcagaatcatagtgtaatctttgggacctatgccatgttcatttcactccttcccatattttttgtgtttcttttggtaaaactataatggttttcattttttacttaatatcacacagttaaactgtccatatttgagctttattttagcttatcagtgataaaaaacaggtagtaactgccattgtttgtttgttttcctaataaggcctgaaaacagccattccttgttaagaaagtgtacaatgtaacatatttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttataccagtggctgggatggtggaattggggttatttctacaattattcttagacgattactaaactgttaagaaatgccccatatcatttttgtatctaggaaagaaaaaaatcagtttcatactgttgtcatctgtcagaaatgctcattttattttgaattaaatgtggcttttgaagtacctagttaccttgaattcctggtgaccacatgtttttatctggaaaacctggagaaagttatctgtcccatctcccctgcttgttttttttttttttttttgggttggagctgctgtttagatgatgcttttactatgcaggagagagtttttgttaaggatatatttgaagattggcttttccatattgtccttcattctttgaccgtggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacaataagtatcatctaatttgggtgtttattttgcagatgagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaaaaa

SEQ ID NO: 302182 - DNA, 4348 bp, Homo sapiens
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtacagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaataactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctgggtcagcggatgcactttagcagatggaacttctagtttatctgaatatttatctttgacaaggtagggctgagcctacatttgcttttgatctatctagtataagaaatattcacagaaattgtatgtagataccctttgttttgaaaatgctgttcagaatcatagtgtaatctttgggacctatgccatgttcatttcactccttcccatattttttgtgtttcttttggtaaaactataatggttttcattttttacttaatatcacacagttaaactgtccatatttgagctttattttagcttatcagtgataaaaaacaggtagtaactgccattgtttgtttgttttcctaataaggcctgaaaacagccattccttgttaagaaagtgtacaatgtaacatatttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttataccagtggctgggatggtggaattggggttatttctacaattattcttagacgattactaaactgttaagaaatgccccatatcatttttgtatctaggaaagaaaaaaatcagtttcatactgttgtcatctgtcagaaatgctcattttattttgaattaaatgtggcttttgaagtacctagttaccttgaattcctggtgaccacatgtttttatctggaaaacctggagaaagttatctgtcccatctcccctgcttgttttttttttttttttttgggttggagctgctgtttagatgatgcttttactatgcaggagagagtttttgttaaggatatatttgaagattggcttttccatattgtccttcattctttgaccgtggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacaataagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaataagatagcttctagcatcagatcaatcccaagaatccatcagcaacctcagaccaacccaagaagataatttaaatctatactgcttattggtcaataagatagcttctagcatcagatcaatcccaagaatccatcagcaacctcagaccaacccaagaagataatttaaatctatactgcttattggtcaataagatagcttctagcatcagatcaatcccaagaatccatcagcaacctcagaccaacccaagaagataatttaaatctatactgcttattggtcaataagctagcttctagcatcagatcattcgcaagaatccatcagcaacctcagacgtcgacc

SEQ ID NO: 302183 - DNA, 783 bp, Homo sapiens
tgctgggattataggcgtgagccactgtgcctggcccccctaccttcattctttgaccgtggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacaataagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaaaaa

SEQ ID NO: 302184 - DNA, 2589 bp, Homo sapiens
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtacagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaataactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctgggtcagcggatgcactttagcagatggaacttctagtttatctgaatatttatctttgacaaggtagggctgagcctacatttgcttttgatctatctagtataagaaatattcacagaaattgtatgtagataccctttgttttgaaaatgctgttcagaagggtcttcccgtgccacagacttgaattatgttggtttcggttgttttctacatagactatggtgagctcatgtag

SEQ ID NO: 302185 - DNA, 1578 bp, Homo sapiens
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtacagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaatggctatggaatatcctaatcctgaaatgtgcattggtgcggttcagcaaaatatcttcctcaagcatttctgggaacactgcttgcgcgcacacccaggtttctcgggaccctgcttgctaccagagagagttcccgactgccg

SEQ ID NO: 302186 - DNA, 1480 bp, Homo sapiens
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtacagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccaccttggttgaccatagaaagcggaaaccgtggaaagtgaaactgtgcataaagggagactactgtacttgaaattctacaataaggagaaaagtcatcagtaaccaacagtaacttataaaaataagtcaggaattatgtgaatttctaaaaaataaaagcttcatatagtaatattcagagcatgaaaatagttttgaaaattgatatttgccaaaatttaataggatgtatggagaataagtttttgtgggtgtgtagaagtaagttaaaatagctttctgttgagaggacattattccttaattgcaggaaattaaaatatgaaagaacgcgactccaaaaatcccaaaaataatatatatataaattatttgccaaatgtatcttgtagtaatcaagttgctcatattaaacaacttactaaagtgga

SEQ ID NO: 302187 - DNA, 1212 bp, Homo sapiens
tctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggttattttgacctcagagtcctcaactgaaatgatggatcttgaattatttcatcttcagaactttatgtattgcgaagtactttttgcctgtggctacgttctgtaagttagctttacacaaaatactaaaggcacagtgaatttcattcaaatgcagtgtggaactctcaggtttccttggtctgcctcagtcttctactcatcagcaccacactgtcaaaatgttggacattacaaggggcgaacatagacataaataaaaaatattggtattgcatagacacttgatgcctaaacctaataatcattaacttttatgtgcaagcttgggttcttgactaattggtaaatgataaatgaaccagattagatccaattattagaaaagcactcttaagagtgcaatgaatgtgatttgaaaacttgaaagcagcctagattttactatattaggtattgttatcaatgggggtttgtcaaccttaaaaattattttttatgtaaagatacctaggaatttctaataactgtatttgttttaataaactttgactttgctgta

SEQ ID NO: 302188 - DNA, 397 bp, Homo sapiens
ctgaggctgtaggcatggcccaggattgccaagcgtagcggaagaccctacccggaccggccaagcacccctttaactggagacgaacttgataatgaccttcatacctctacagagattttttttttttttccggtctttctgagcaggtacaaagaagaaaagagaagaaaaagatggggggaaaaaatcaaaccacaatggattgttgtttcctagttgggataggagtggtaagggaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaaaaa

SEQ ID NO: 302189 - DNA, 2713 bp, Homo sapiens
  misc_feature (2)..(2): n is a, c, g, or t
angaagcagaaaaggttggataaaagataaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcctccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagttgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaatggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccctccctgggctctgtcagctagcagagcatttggtggaagaaagacagcccagctcttgccatgattgggagccgcagccatctctagatgaaagggggaatgtgtagaggagaaattgcctctttataaagagcccagtttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctg

SEQ ID NO: 302190 - DNA, 1158 bp, Homo sapiens
ctataatatatgcatttattactttgataatttttttgatatagcatcatgattaagcaactttgttatgcaacagaatgtttatgccataaatcttgcaaagtatgaattacctaaatcttgacaaaggtaaacaaaaatttatctttgataggtgtcaatcagtaatgttagttttggtgcagttgcaacctgttgatttttttttttcttaaactgagatcaaatattgtacacttgacttactattcttcgctttataatagtgaataatctatatgggaatatcagttgatattctttcctggcaaaagctatatattttaaattactgattccagtctctttgtctttttaacttagaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaac

SEQ ID NO: 302191 - DNA, 1269 bp, Homo sapiens
ggtgagcgtacactggatgccatgtcccttgtggacagcagtttccctggtgagtgcacattcactagaatggcagcccgcacagtggcacagcagcacggggacccgggtgtgaaatgctcagcccacgtaatggcacagcccacgtaatagcgcgtgcagtgtgctgggagtctggggaattagaggtggattcaaatgtaatttagaaacttggaaatcattttaatagtgaaattatgggtgatttttgctttttaaaacttgtttaaatgctgtcatatggttaaaagataaaagcagtgggaggtcatgttttccgtttttggaaagggacagtatctcctgaataagtgggaggaaaagtcctttaactcatcgctttcagcaccacctgtgctggccttcacgttctgtctgtgtaagtggagggtttccaggcagtgtaagccctaacctggactgaagtccttgaggggaaggggtctgtgatgtcctgccttgtgatctgtcccccattcccttcccctgcaggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaac

SEQ ID NO: 302192 - DNA, 3754 bp, Homo sapiens
ggaactgcaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggggcctttacaacaactaaacggacaggcattccagccccacgggaattttcagtaactgtctcaagagagaggtctgtgccacgtggtccctccaaccccaggaaatcagtgtccagtccaacttcctccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagttgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaatggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcggccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaac

SEQ ID NO: 302193 - DNA, 3090 bp, Homo sapiens
ggaactgcaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggggcctttacaacaactaaacggacaggcattccagccccacgggaattttcagtaactgtctcaagagagaggtctgtgccacgtggtccctccaaccccaggaaatcagtgtccagtccaacttcctccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagttgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaatggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcggccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcgtcgacgcggccgcgaatttagtagtaaaaccgggaattc

SEQ ID NO: 302194 - DNA, 3637 bp, Homo sapiens
ggaactgcaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggggcctttacaacaactaaacggacaggcattccagccccacgggaattttcagtaactgtctcaagagagaggtctgtgccacgtggtccctccaaccccaggaaatcagtgtccagtccaacttcctccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagttgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaatggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcggccttggcccgggaatacggtggttccaagcgcaatgctctactgaaatggtgccagaagaagacacaaggttatgcgaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaac

SEQ ID NO: 302195 - DNA, 3944 bp, Homo sapiens
cagaatagagtggctgacttgctgattgaggtcggcagctcccgagaagcaggagaagcagagtttttgcagacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcctccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagttgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaatggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcggccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaac

SEQ ID NO: 302196 - DNA, 3643 bp, Homo sapiens
atggcatgtagtgaggacaagaattactaaaggcaaatggtgaaattaaacatgtttccagtctgctggccaaggggcctttacaacaactaaacggacaggcattccagccccacgggaattttcagtaactgtctcaagagagaggtctgtgccacgtggtccctccaaccccaggaaatcagtgtccagtccaacttcctccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagttgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaatggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcggccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaac

SEQ ID NO: 302197 - DNA, 2863 bp, Homo sapiens
ggaactgcaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggggcctttacaacaactaaacggacaggcattccagccccacgggaattttcagtaactgtctcaagagagaggtctgtgccacgtggtccctccaaccccaggaaatcagtgtccagtccaacttcctccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagttgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaatggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccctccctgggctctgtcagctagcagagcatttggtggaagaaagacagcccagctcttgccatgattgggagccgcagccatctctagatgaaagggggaatgtgtagaggagaaattgcctctttataaagagcccagtttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccac

SEQ ID NO: 302198 - DNA, 2843 bp, Homo sapiens
ctcggggttgtcaagttacacaataatcaactcatcagtgagctagaaaggggtgtgatcatgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaatggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcggccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaac

SEQ ID NO: 302199 - DNA, 2174 bp, Homo sapiens
ggaactgcaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcggccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaac

SEQ ID NO: 302200 - DNA, 1180 bp, Homo sapiens
cgcgggtccctctcctgagcatcagtgagcgcccggagccgtggccgctgggggttgcggcggcgctgagccagcggggccggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccctccctgggctctgtcagctagcagagcatttggtggaagaaagacagcccagctcttgccatgattgggagccgcagccatctctagatgaaagggggaatgtgtagaggagaaattgcctctttataaagagcccagtttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccac

SEQ ID NO: 302201 - DNA, 427 bp, Homo sapiens
tagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagtttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaa

SEQ ID NO: 302202 - DNA, 441 bp, Homo sapiens
tccaactctccatcaaagtcatgaatcctgtttacaacaacctgatgagatgtcaactacttttcacgtgaacacacccaggaattaggaaggcattccctaaccggcagctcttatctctcccaatcacgatttgagcttcaccaaataactcaaacccctgtttcctcacatattaaaggggagtaaatatctgctttacagaacattgttgggagaataaaaggagatagaggaatataaatggcctaatccacttacagaggagggtgtgcaatgttagtcccctttttgcctccttttatgggacagcacattccatttttggatcgtcatcacctagagaaaggtcttccttaatactgaattgtctttgtatccttttagcacctttcttaagtttaaccctaagtggtctcatagaatgtcatttttccgtcc

SEQ ID NO: 302203 - DNA, 4632 bp, Homo sapiens
gcgctctcgggcactatgtgcttccggtctccaataccgcaggagggcggtcttccccggctcgccaactcggctgctctgggggattcgtgcgcggtaagaagctgcgcggtagcgcggtgaggtgaggttctcagccaccaaagctgcagggtctcgtcgttcgttccctctggcctggcggaacttgcgtgggaagctgggaggacagaaggcttagccgctgggtccctgagctggctggagcgcgggctgtctaggggcggcgacctcagctgttgggctccggctgctgggggctgtgcgtccagccgccctggaatccgcctgtgggtgggccgcttggctctcccacttcaccctcttgataacccagagcctcccccttcccacgtacgtaggggaaggataatctacttccttttgaacagcttcggtccccactatgacagtcgcataaacttcagcgaagagtgcgctggtaaagtggcatggagtttctcacaccaattcattgggtccacccttcagcttctgtggaaggggtctttctgttactaggagctgagacttggggggttgccagggatgctggtcttaaaaggtgataatttaggccgggcgcggtggctcacgcctgtaatcccagcactttgggaggtcgaggcgggcagatctcctgagctcaggagttcgagaccaccctgggcaacatggtgaaaccccttctctactaaaatacaaaaaattagctgggcgtggtggcacgcgcctgtaatcccagctattcgggaggctgaggcccgagaatcgcttgagccctggcggcagaggttgcagtgagccaagatcgcccactgcactccaggttgggctacagagtgagactccgtctcaacaacgaccacaacaacaacaaaaaaggtggtggcttaatacagccatgctccccttaagaactggtatagttatgagaaatggttgggccgtttcgtggttgtgtgaacatcatagtgtacttgcacaaacctacacagctgggccgtatgggatagcctgttactcctagtctacagacctgtacagtataactactaaatactgtaggcagttgtaaaaggatggtgtgtatctaaacacagaaaagatactgtaaaaatatagtgtaaaagaaaacatggtacagctgaatagggcacttacgcatggagcttgcagggctgtcggtagctattaagtgagtcagtgagtggtatgtgagtgtgaaggcctacgatattatttagggtattactgtacactactgtagactttataaatgcggtatgcttagtctaagtttattaaaaataaggtaataaccttagcttactgtgcttttttaactttataaacttttaaattaattttaactccttgacctttttttttttttttgagacggagtttattctctctgtctctcatttttgagacagagttttgctcttgtcacccaggctggagtgcagtggcgcaatctcagctcactgcaacgtccacctcttgagttcaagcgattctcctgcctcagcttcccaggtggtgcgcgcctgtagctgggactacaagagtgcgccaccacgcccagctaatttttgtatttttagtagagatggggtttgaccatgttggccaggatggtctcgatatcctgaccttgtgatccacctggccttggcctcccaaagtgctgggattacaggcgtgagccaccatacccggcccactcttttgtaataacacttagcttaaaatgctaatgtgttgtatagctatataaaaatattttctttattcccttacattattctatagctttttcctgtaaaaattttttttgttgttataaactaagacacacacattgtgcctacaccgggtcaggagcatcaatatcactcttttcttcctccacatcttgtcctactggaaggttttcaggggcagtaacatgaatggagctgtcatctcctataataactgcttttttctggaatacttataattgtctagtattatgtacagtacatcattgtaagcattatgcttgtatatgactggcatcccaggtttgtttacaccagcattaccacagacatgagtaatgtgttacactacaagttatgagggctacaaagtcaataggaatttttcagctccattataatcatctgagaccagtatcatgtgtgcagtcgctgttgacctaaatgttatgtagcatgtgactagctgatgaatctttgattatggctgaatgttctcattcattgcaggaaaaaaatatcctccaaatcactaggtagtatgtaagtgaccaaaacttttttccattttatgttggagccaaatcattagtgttaggataaattacttctttatgtatgtgctctaaaatgaaaagttatttctgaatattaaagcatatgtattaagagtataaaaacaagatacagattttggtgtgaaatatatcttatgattcaagtcataatttaaatagaattgaagatgatgtgaaatcactgggctggaagtagcttataccttgattagtaagaggaagcccgggatcatcctgtgatggtaaacacttttatatgttttacttataactttgccaggaaatttcaacaaacttcatattaaaggacatgatttctgtatacttagtaatctgctatgcaaattgttgcattgaaatggcagacgaagcaagaagattgggagaaagtagctgtgggacttggagataggaaaataaacagccgggaaaactgcagaatgtgggaggaataattgcattcattgtattactatctgatttatattttatgaaataatttggtttcttaagatagtttttcaattttaagcacaccttttttaactggtgtggcagcttttctggtaagtggtagatttatgttagaagcatgtctatgcagcatattatagcattaaatatgtatacagatatctaactgaaataaaaagtgttttaataattaaaagtttaacatatgggcatatgtgacatatagtgatatagcatgtctctttagttttgttgtttttgttgttgatggctaaccacccatgcttgtcttaaaaattgataaggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttg

SEQ ID NO: 302204 - DNA, 1433 bp, Homo sapiens
gcgctctcgggcactatgtgcttccggtctccaataccgcaggagggcggtcttccccggctcgccaactcggctgctctgggggattcgtgcgcggtaagaagctgcgcggtagcgcggtgaggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaag

SEQ ID NO: 302205 - DNA, 2049 bp, Homo sapiens
gcgctctcgggcactatgtgcttccggtctccaataccgcaggagggcggtcttccccggctcgccaactcggctgctctgggggattcgtgcgcggtaagaagctgcgcggtagcgcggtgaggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttgacataaaggattccaagttactgaagttaaaattgaaatatctcagtttaacagcagctcttttttgcccttgattttcaagagagaacttctagccaaaattcagtttttgttacttaaccagaatgatggcagataacagatggtataataaacttaatagcattttgttctcatgttttagatgagtcagagtaagatggaagtatcaccataatagagttagaacactaatcagagacccattagcttctttgtttgatttgatgaattcatgcatacttaatacatatatttcacaaggcttaacactaccattgtactgtataatggaatgactctagtggttttgtgtttcatttgaaattttacctgattgaatccatttgtaactaaaggaaacagctgtgattagttactgatgcctcaaaagcaaaatatttaccaaataagaaaag

SEQ ID NO: 302206 - DNA, 2021 bp, Homo sapiens
gcgctctcgggcactatgtgcttccggtctccaataccgcaggagggcggtcttccccggctcgccaactcggctgctctgggggattcgtgcgcggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttgacataaaggattccaagttactgaagttaaaattgaaatatctcagtttaacagcagctcttttttgcccttgattttcaagagagaacttctagccaaaattcagtttttgttacttaaccagaatgatggcagataacagatggtataataaacttaatagcattttgttctcatgttttagatgagtcagagtaagatggaagtatcaccataatagagttagaacactaatcagagacccattagcttctttgtttgatttgatgaattcatgcatacttaatacatatatttcacaaggcttaacactaccattgtactgtataatggaatgactctagtggttttgtgtttcatttgaaattttacctgattgaatccatttgtaactaaaggaaacagctgtgattagttactgatgcctcaaaagcaaaatatttaccaaataagaaaag

SEQ ID NO: 302207 - DNA, 2406 bp, Homo sapiens
gcgctctcgggcactatgtgcttccggtctccaataccgcaggagggcggtcttccccggctcgccaactcggctgctctgggggattcgtgcgcggtaagaagctgcgcggtagcgcggtgaggtgaggttctcagccaccaaagctgcagggtctcgtcgttcgttccctctggcctggcggaacttgcgtgggaagctgggaggacagaaggcttagccgctgggtccctgagctggctggagcgcgggctgtctaggggcggcgacctcagctgttgggctccggctgctgggggctgtgcgtccagccgccctggaatccgcctgtgggtgggccgcttggctctcccacttcaccctcttgataacccagagcctcccccttcccacgtacgtaggggaaggataatctacttccttttgaacagcttcggtccccactatgacagtcgcataaacttcagcgaagagtgcgctggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttgacataaaggattccaagttactgaagttaaaattgaaatatctcagtttaacagcagctcttttttgcccttgattttcaagagagaacttctagccaaaattcagtttttgttacttaaccagaatgatggcagataacagatggtataataaacttaatagcattttgttctcatgttttagatgagtcagagtaagatggaagtatcaccataatagagttagaacactaatcagagacccattagcttctttgtttgatttgatgaattcatgcatacttaatacatatatttcacaaggcttaacactaccattgtactgtataatggaatgactctagtggttttgtgtttcatttgaaattttacctgattgaatccatttgtaactaaaggaaacagctgtgattagttactgatgcctcaaaagcaaaatatttaccaaataagaaaag

SEQ ID NO: 302208 - DNA, 2283 bp, Homo sapiens
gcgctctcgggcactatgtgcttccggtctccaataccgcaggagggcggtcttccccggctcgccaactcggctgctctgggggattcgtgcgcggtaagaagctgcgcggtagcgcggtgaggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggtatgtgtttctttcagttttttgttttgttcatggggaaagccaataaatagcaccttgggtatttttttaacacaatttgttacgagtgtgccacttagtatttggaaatcatatgagattaaattttaagttatgtaaatatattttttattcagagtattttaaaataatgttaattttatgacttgccatatgtattgtcaactgaataggaactgttgatttttacaggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttgacataaaggattccaagttactgaagttaaaattgaaatatctcagtttaacagcagctcttttttgcccttgattttcaagagagaacttctagccaaaattcagtttttgttacttaaccagaatgatggcagataacagatggtataataaacttaatagcattttgttctcatgttttagatgagtcagagtaagatggaagtatcaccataatagagttagaacactaatcagagacccattagcttctttgtttgatttgatgaattcatgcatacttaatacatatatttcacaaggcttaacactaccattgtactgtataatggaatgactctagtggttttgtgtttcatttgaaattttacctgattgaatccatttgtaactaaaggaaacagctgtgattagttactgatgcctcaaaagcaaaatatttaccaaataagaaaag

SEQ ID NO: 302209 - DNA, 1648 bp, Homo sapiens
gcgctctcgggcactatgtgcttccggtctccaataccgcaggagggcggtcttccccggctcgccaactcggctgctctgggggattcgtgcgcggtaagaagctgcgcggtagcgcggtgaggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttgacataaaggattccaagttactgaagttaaaattgaaatatctcagtttaacagcagctcttttttgcccttgattttcaagagagaacttctagccaaaattcagtttttgttacttaaccagaatgatggcagataacagatggtataataaacttaatagcattttgttctcatgttttagatgagtcagagtaagatggaagtatcaccataatagagttagaacactaatcagagacccattagcttctttgtttgatttgatgaattcatgcatacttaatacatatatttcacaaggcttaacactaccattgtactgtataatggaatgactctagtggttttgtgtttcatttgaaattttacctgattgaatccatttgtaactaaaggaaacagctgtgattagttactgatgcctcaaaagcaaaatatttaccaaataagaaaag

SEQ ID NO: 302210 - DNA, 1620 bp, Homo sapiens
gcgctctcgggcactatgtgcttccggtctccaataccgcaggagggcggtcttccccggctcgccaactcggctgctctgggggattcgtgcgcggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttgacataaaggattccaagttactgaagttaaaattgaaatatctcagtttaacagcagctcttttttgcccttgattttcaagagagaacttctagccaaaattcagtttttgttacttaaccagaatgatggcagataacagatggtataataaacttaatagcattttgttctcatgttttagatgagtcagagtaagatggaagtatcaccataatagagttagaacactaatcagagacccattagcttctttgtttgatttgatgaattcatgcatacttaatacatatatttcacaaggcttaacactaccattgtactgtataatggaatgactctagtggttttgtgtttcatttgaaattttacctgattgaatccatttgtaactaaaggaaacagctgtgattagttactgatgcctcaaaagcaaaatatttaccaaataagaaaag

SEQ ID NO: 302211 - DNA, 1556 bp, Homo sapiens
gcgctctcgggcactatgtgcttccggtctccaataccgcaggagggcggtcttccccggctcgccaactcggctgctctgggggattcgtgcgcggtaagaagctgcgcggtagcgcggtgaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttgacataaaggattccaagttactgaagttaaaattgaaatatctcagtttaacagcagctcttttttgcccttgattttcaagagagaacttctagccaaaattcagtttttgttacttaaccagaatgatggcagataacagatggtataataaacttaatagcattttgttctcatgttttagatgagtcagagtaagatggaagtatcaccataatagagttagaacactaatcagagacccattagcttctttgtttgatttgatgaattcatgcatacttaatacatatatttcacaaggcttaacactaccattgtactgtataatggaatgactctagtggttttgtgtttcatttgaaattttacctgattgaatccatttgtaactaaaggaaacagctgtgattagttactgatgcctcaaaagcaaaatatttaccaaataagaaaag

SEQ ID NO: 302212 - DNA, 1337 bp, Homo sapiens
gcgctctcgggcactatgtgcttccggtctccaataccgcaggagggcggtcttccccggctcgccaactcggctgctctgggggattcgtgcgcggtaagaagctgcgcggtagcgcggtgaggtgaggttctcagccaccaaagctgcagggtctcgtcgttcgttccctctggcctggcggaacttgcgtgggaagctgggaggacagaaggcttagccgctgggtccctgagctggctggagcgcgggctgtctaggggcggcgacctcagctgttgggctccggctgctgggggctgtgcgtccagccgccctggaatccgcctgtgggtgggccgcttggctctcccacttcaccctcttgataacccagagcctcccccttcccacgtacgtaggggaaggataatctacttccttttgaacagcttcggtccccactatgacagtcgcataaacttcagcgaagagtgcgctggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgagagcatcacttctaccatgttatttactttatttagctggaaactattcttatattcacacacatatataccttagccagctctggttaccattatgtcccagatttatagagcatcgttttaaggactagtacttttttagcacatatatgctaggcacatgatgtactggttaattattacaacaacacagcaaaggtgatggcatatattcccatattatggatggcaaacactgaagtgcagatagattaaataacctgtggaagccacttagctagtagcagaggtgacattcaaacccagcctgacttcaaaacctacgttatagaccagatgtggtggcccatgcccgtgatcccagcactttaggaagctgaggcgggaggatcacttgagcccaggaattaaagacgagccagggccacatagggagacgccatgtctacca

SEQ ID NO: 302213 - DNA, 1249 bp, Homo sapiens
gcgctctcgggcactatgtgcttccggtctccaataccgcaggagggcggtcttccccggctcgccaactcggctgctctgggggattcgtgcgcggtaagaagctgcgcggtagcgcggtgaggtgaggttctcagccaccaaagctgcagggtctcgtcgttcgttccctctggcctggcggaacttgcgtgggaagctgggaggacagaaggcttagccgctgggtccctgagctggctggagcgcgggctgtctaggggcggcgacctcagctgttgggctccggctgctgggggctgtgcgtccagccgccctggaatccgcctgtgggtgggccgcttggctctcccacttcaccctcttgataacccagagcctcccccttcccacgtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgagagcatcacttctaccatgttatttactttatttagctggaaactattcttatattcacacacatatataccttagccagctctggttaccattatgtcccagatttatagagcatcgttttaaggactagtacttttttagcacatatatgctaggcacatgatgtactggttaattattacaacaacacagcaaaggtgatggcatatattcccatattatggatggcaaacactgaagtgcagatagattaaataacctgtggaagccacttagctagtagcagaggtgacattcaaacccagcctgacttcaaaacctacgttatagaccagatgtggtggcccatgcccgtgatcccagcactttaggaagctgaggcgggaggatcacttgagcccaggaattaaagacgagccagggccacatagggagacgccatgtctacca

SEQ ID NO: 302214 - DNA, 491 bp, Homo sapiens
gcgctctcgggcactatgtgcttccggtctccaataccgcaggagggcggtcttccccggctcgccaactcggctgctctgggggattcgtgcgcggtaagaagctgcgcggtagcgcggtgaggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtaagtactgttaccctcatatagcagaaatggtgagtcatcgtgcagttgtgatttaatttacactcaatcacagttcttgaataaattcttgaataaattgcaaaaccttgagaattacat

SEQ ID NO: 302215 - DNA, 2381 bp, Homo sapiens
caatatattcctcgttagggcaggcgcggcccttcggctccgagctgaccctgatcagggccgagttgtctcggcggcgctgccgaggcctccacccaggaccccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaa

SEQ ID NO: 302216 - DNA, 707 bp, Homo sapiens
cggacgcgtgggtcgacccacgcgtccaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaa

SEQ ID NO: 302217 - DNA, 1157 bp, Homo sapiens
cggacgcgtgggtcgacccacgcgtccaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaaaaaaaaaaataacaaaaaaacaaaaacaaaaagaaaaaaaaaagcacaaaacaaaaaacaaacaaagggggggcgggcccccctatatgtatgatgaggcgaacagcaaccacatttatctcacatggggcaccagctgtgtacaagattaagaacacgcgcgacagtggggtgcagagagacgtacatggaaaaaccacaaattatattagaggggggggccaccaacacgcgcgtgcaaagaacagcctacaggcgggagagaggactctaaggaaatcatgccgcccgaccccattctggtgcgacccacgcgtgtgggtgtggcgcggggggcaccaactttgaaagaaagtaccccaccaagaaaaagggcccagaacaacaaaatggtgtgctgtggacaacacgcagaaaaccaagggcgggcacaataatcacgaggacaagctactgggtgggtcccccattcaggttattgaaaacgggcaaaaccgggcaaaagcattaaggcaagaaaaaag

SEQ ID NO: 302218 - DNA, 2473 bp, Homo sapiens
caatatattcctcgttagggcaggcgcggcccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaa

SEQ ID NO: 302219 - DNA, 2615 bp, Homo sapiens
caatatattcctcgttagggcaggcgcggcccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaaaaaaaaagggggcggtctaaaccgaggcagttccgtccattggacagccaagggctaaaagagcgcgtaacacagacacaccgttgggaccttgggtggaccacaaccgaaatttgcgcccgttgatactacacgccttatt

SEQ ID NO: 302220 - DNA, 2424 bp, Homo sapiens
caatatattcctcgttagggcaggcgcggcccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctagattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaa

SEQ ID NO: 302221 - DNA, 2997 bp, Homo sapiens
caatatattcctcgttagggcaggcgcggcccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaaaaaaaaaaataacaaaaaaacaaaaacaaaaagaaaaaaaaaagcacaaaacaaaaaacaaacaaagggggggcgggcccccctatatgtatgatgaggcgaacagcaaccacatttatctcacatggggcaccagctgtgtacaagattaagaacacgcgcgacagtggggtgcagagagacgtacatggaaaaaccacaaattatattagaggggggggccaccaacacgcgcgtgcaaagaacagcctacaggcgggagagaggactctaaggaaatcatgccgcccgaccccattctggtgcgacccacgcgtgtgggtgtggcgcggggggcaccaactttgaaagaaagtaccccaccaagaaaaagggcccagaacaacaaaatggtgtgctgtggacaacacgcagaaaaccaagggcgggcacaataatcacgaggacaagctactgggtgggtcccccattcaggttattgaaaacgggcaaaaccgggcaaaagcattaaggcaagaaaaaag

SEQ ID NO: 302222 - DNA, 2481 bp, Homo sapiens
caatatattcctcgttagggcaggcgcggcccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattaactttattgaaaggtatatcccttagtactaaaacataatggtcgacgcggccgcga

SEQ ID NO: 302223 - DNA, 2449 bp, Homo sapiens
caatatattcctcgttagggcaggcgcggcccttcggctccgagctgaccctgatcagggccgagttgtctcggcggcgctgccgaggcctccacccaggacctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaa

SEQ ID NO: 302224 - DNA, 2349 bp, Homo sapiens
gctagtacgaggcctggtgtgaatcggccgaggcaggccgagttgtctcggcggcgctgccgaggcctcccccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaa

SEQ ID NO: 302225 - DNA, 2062 bp, Homo sapiens
caatatattcctcgttagggcaggcgcggcccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaa

SEQ ID NO: 302226 - DNA, 2278 bp, Homo sapiens
caatatattcctcgttagggcaggcgcggcccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaaggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaa

SEQ ID NO: 302227 - DNA, 2552 bp, Homo sapiens
caatatattcctcgttagggcaggcgcggcccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaagtttcagcccacttgaagttttgtgccagccttcttacctaattaaacaacacttcagcagcgtggttgctaatgccaggtaaccaccatgtgttatgttagcctgcttggatcaattgtaattattactggaattgaattaattaatatgattttgaacagttcatgttcaaactaacatcctgtaaagtagacactgcaaggagttactgatgaaagaaaagttgttcataaaagaagcctccttttataattgacttgccttagacttatttaataatgtttcatagtattttttaaaaagtatctgaaccttgtacatatttacaattatgagacatcctatctaaaaatttatattttcgatttaacatttgtggctggcagtgataatttttactctctggtactatgaatcatctcattaaaatcctctcaactgaatgacattatcccaatttgcaaatgaaagagagacagagaacctaatgatttgcccctggtctatacctggtacttggaggtaggattcaaagccaggcagttctgactccagaggctgtgctcttaaccactctatacattacctctcaaaatagaagattaattggactc

SEQ ID NO: 302228 - DNA, 2419 bp, Homo sapiens
caatatattcctcgttagggcaggcgcggcccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaa

SEQ ID NO: 302229 - DNA, 2141 bp, Homo sapiens
caatatattcctcgttagggcaggcgcggcccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaagtttcagcccacttgaagttttgtgccagccttcttacctaattaaacaacacttcagcagcgtggttgctaatgccaggtaaccaccatgtgttatgttagcctgcttggatcaattgtaattattactggaattgaattaattaatatgattttgaacagttcatgttcaaactaacatcctgtaaagtagacactgcaaggagttactgatgaaagaaaagttgttcataaaagaagcctccttttataattgacttgccttagacttatttaataatgtttcatagtattttttaaaaagtatctgaaccttgtacatatttacaattatgagacatcctatctaaaaatttatattttcgatttaacatttgtggctggcagtgataatttttactctctggtactatgaatcatctcattaaaatcctctcaactgaatgacattatcccaatttgcaaatgaaagagagacagagaacctaatgatttgcccctggtctatacctggtacttggaggtaggattcaaagccaggcagttctgactccagaggctgtgctcttaaccactctatacattacctctcaaaatagaagattaattggactc

SEQ ID NO: 302230 - DNA, 877 bp, Homo sapiens
cggacgcgtgggtcgacccacgcgtccctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaa

SEQ ID NO: 302231 - DNA, 1407 bp, Homo sapiens
  misc_feature (418)..(418): n is a, c, g, or t
aaggttaaaaccctggttttttttaacccattatacaaaccgtgttttaagaagccatccttgttaagacttttgcttgataaaccaagtttttacactcttaaaatcttgggacccattttggaaagggaaattccccctttatagaaaccattcttaaatcttttttcaaggccaaggcctttttcaaagatgttctaaattaaggttttaattggacagggggtgctcctttacctttgtgggccttttttttcctgttcaaagcatcttttttggattttttggggggcaaaaccaaaggtttaaaagggggcccaattccccaagttggaaaaggttaattaatttttgcctgccgtgaagtgtttaattaagaaaaaattttgccccaattcagctttctaacttaaaaacnagtctgtagtaaaaaattctggagtgttcaatctagtctgaacttaccttagtgtgggaaagcaagttttcgaagtgataatttattttgagttactaatacaatagaaactagttttcttgatgggattcagtttgagctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaa

SEQ ID NO: 302232 - DNA, 312 bp, Homo sapiens
ttaggatgtgaccaacttgtagaagggaaataaataacagatggcactttgcaatgacttagatgcactagccgcattgggggatgggaggcttataaatcatttcttggcccagtgcaaagatggccaaggaaagcaggaaggactactcttacactccttgctggtctttttttctatatatagatgatagaggtactgacaacaactgactctcagaaactgctacaccagctgaatgccctgttggaacaggagtctagatgtcagccaaaggtctgtggtttgagactaattgagtctgcacacgat

SEQ ID NO: 302233 - DNA, 446 bp, Homo sapiens
cggagttctagattatcctttatgttttaattgaaataaggtagagtcatgggcttactggttttgtttttgattttttaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggtaagtgacctttgttttgaacaagagacatttggaaatcagaatggtattgtatggatattgcataaaatcagtatcctcatagaattctaataaaaataagtaaaatga

SEQ ID NO: 302234 - DNA, 429 bp, Homo sapiens
gggtcggagttctagattatcctttatgttttaattgaaataaggtagagtcatgggcttactggttttgtttttgattttttaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggtaagtgacctttgttttgaacaagagacatttggaaatcagaatggtattgtatggatattgcataaaatcagtatcctcatagaattc

SEQ ID NO: 302235 - DNA, 490 bp, Homo sapiens
tgtagaggcagtgttgtcactgtgttgcccaggcggatctcaaactcttgggctcaagtgatctgcccacctcgttctcccaaagtgctgagattacaggcataagccaccgtgcctagcctctaatgtttttttaatagacatagaatgatgacaaataattgtttaatgtgtattaaaagttggtgtttatgcattattaatcccttttatcacttagattcatcactgctatggatgctatccttaatatatatttacttttagtttcagcccacttgaagttttgtgccagccttcttacctaattaaacaacacttcagcagcgtggttgctaatgccaggtaaccaccatgtgttatgttagcctgcttggatcaattgtaattattactggaattgaattaattaatatgattttgaacagttcatgttcaaactaacatcctgtaaagtagacactgcaaggagttactgatgaaagaaaag

SEQ ID NO: 302236 - DNA, 6927 bp, Homo sapiens
  misc_feature (2607)..(2607): n is a, c, g, or t
tgccagggcgacgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggaacaaggaacaagggttcatagcatgcggtggtgaagatggattactgaaagttttgaaattagagacgcagacagatgatgcaaaattgaggggccttgcagcccccagtaacctttctatgaatcagactcttgaaggtcatagtggttctgttcaagttgtaacatggaatgagcagtatcagaagttgactaccagtgatgaaaacgggcttatcattgtgtggatgttatataaaggctcttggattgaggagatgatcaacaatcgaaataaatcagttgttcgcagtatgagctggaatgctgacggacagaagatctgcattgtatatgaagatggggctgtgatagttggttcagtggatggcaatcgtatttggggaaaagacctgaagggtatacagctatcccatgtaacatggtctgcggacagtaaagtcttactttttggaatggcaaatggggaaatacacatttacgataatcaaggaaattttatgataaaaatgaaactgagttgtttggtgaatgtcactggagctatcagcattgctggaattcattggtaccatggcacagaaggctacgtggagcctgattgcccttgccttgctgtttgctttgataatggaagatgccaaataatgagacatgagaatgaccaaaatcccgttttgattgacactggcatgtacgtagtaggcatccagtggaaccacatgggcagcgtgttagctgtggcaggcttccagaaggcagccatgcaggacaaagatgtgaacattgtgcagttttacactccgtttggtgagcatctgggtactttgaaagttcctggaaaggaaatatctgcactatcttgggaaggaggtggactgaaaattgcactagctgttgattcctttatatattttgcaaacattcgacctaattataagtggggttattgctcaaacactgtagtttatgcatataccagacctgatcgtccagaatattgtgttgtcttctgggatacgaaaaacaatgaaaaatatgttaaatatgtgaagggtctcatttctattactacctgtggagatttctgcattttggctacaaaagctgatgaaaatcatcctcagtttgtactagttctttgtaattctattggtacacccttggatcccaaatacattgatattgtaccattgtttgttgcaatgaccaaaacccatgtgatagcagcctcgaaagaagcattttatacctggcaatatcgtgtggcaaagaagctcacagcattggaaattaatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggaacccattcagacctctggatatatttgtaattttgaggatttagaaattaaatctgttcttttggatgagatattaaaggatccagaacatccaaacaaggattacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgangggttagagaaccttgccatttcacttccagaaaaccacaagttacttccagaaatagcacaaatgtttgtcagagttggaatgtgtgaacaagcagtgactgcatttttgaaatgtagtcaaccaaaggcagcagtagatacctgcgtacatctcaaccaatggaacaaagctgttgaattggctaaaaatcatagtatgaaagaaattggatctctgttagctaggtatgcatctcatttactggaaaagaataaaactcttgatgccatagaactctatcggaaagccaattacttttttgatgcagctaaactgatgtttaagattgcagatgaagaggcaaagaaaggaagtaaacctttacgtgtcaagaagctctatgtactgtcagccttacttatagagcaataccatgaacagatgaagaatgcccagcgaggaaaagttaaaggaaaaagttcagaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacagctcttcacctgaaagactatgaagacatcatccctcctgtggagatctactctctgctagcactctgcgcatgcgccagcagagcctttgggacttgttcaaaagctttcattaaacttaaatctttagagaccctcagttcagaacagaaacagcagtatgaagaccttgctttagaaatcttcaccaaacatacttcaaaagataacagaaaacctgaattggacagccttatggaaggtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgttaataaaataatttttatggcaatacaactgtgaaataataaggccgattttcatataaatgtatgaaaatcaaccatgttttctctcaccctctctcttttgtttatcttgtttttggttacatgataccatggaaatattccaaataaatttttttctcacagtgtcaaggtaactgaattcattaaaaaatcttgaagggagtagggagtgggggaagcatgggagtggggcaaagttgaatttagagaatttttataacccatgttacaaggaagttaaacaattgtaataatgaaatgagctttctctatagccatatttaattaaataagtgtcgaatgtcttctttattgtattttcagaagtgaggcgatggcattttaagacattttttacaatctgaattgtttctaatagccctattcttctattttaaaacctgtccttttagtctcatttaagagatggcatttggaatttacactttcatatgattgtgcagaaaacttgcctctatttataatgaagataacttaaacagaaatatccattttgtagttatagcttctgttgaaacattgtcactaagttggaccgtttatttacacaagtattgttgagggagtgattttttcttgatatgcgtctgttttcatttattattaatttgaaagataaacagttgtgatccataatggatcatttcttatgtcttttacatagctaataatgttctctgtttatttctcatgaattcccattttgtggctaaagaccagacctttgcactatttcatcaagattattttattgaggtttggcttacatatagtagaggcaatacatagagatacgcaactttgtttttgcagctacaatacactttctcaatctcatatgtttttgtcttgtagagacagagacaagttcagcatgttgcagattgggaatagtgagctatgagaagagatttagagcctagatgagcttaggatagagagtgggctcattggcctaaataaaaagagaagaccagaagtctttgaggtctctgtctctattcatgcgcctcgtggaaaattaccttggtacaatggtagcctctaaatagactgcctcgcaagctattccagaggtcatggaacagaaagccttataaaccaaataaaaattctcaaaatacattggtttattgaaccaatttgcaatacacagtgaggaacaaggagaaagcaatgatagattaacactgttagtgtaacgtgccagtggagtggaaagaccgcaacacctgaatcctgggttttgtaatgtttttatgtcctgactcacattctgtcacatacgctttcccctaatagtcgggttacaaaaaggaccagagtggccgcttgagccagatgactcaatcagatgaaatgtgcctgaggccaacgatgtacacttgctctatagaagggtgtcaggggcaagtacacttcaccacagcaatagcttgcctattagtctgctgagcagtcatgaattttattgtatttcttgggtaaggacaggccagaatgagtgtcaccagtgggtaattgaatcaacttctcacacatactgaaggctttatatgtctcatgcatacttagtgtatcatgaatatttggtatctttgtggcttttcatatttttagtgcttcatgaatatttggtatctcttgctcctttctatctgtggtcacacatacacgctctattaactttgcctaataagtctcctaggttactaacttacttacctaaatgtaacacaatgaattccagctttctcatttgttctataccagaatgggaaatttccccaaatcagaaaatcacatcctaacaaagaagtctgtctaagacagtacatctcctgttgaacttgcatctttccacaggactttctgtttttagggatgagactattctctgcttcatcaaggaaagagaaatgttcagggttgtagggatggcacacttattagttctgcctgtctgaaaggttcctgcaggacagtttggtcagagctgcaattcttagtccatggtctaatgcttgagtatctcttctttccctttcctgtctcaggaatcagctgagaattcattcgattgtcatgcctctagccccttactgtgatttgttggttgcactttcatttgctttagttctagaatcacctgttgactcctcagacttcacctaactttggaaactctcttttggaggcttctcatttccccctaattctgtgctgcctgagccctagaattttcccaccaacgaattattccaggtagatcctaagttgctggatctagttgatatttaaacaatatctagttgatatttctcattcagttggatccagaaaccagtatctctaaaaacaacctctcataccttgtggacctaattttgtgtgcgtgtgtgtgtgcgcgcatatgtatatagacaggcacatcttttttacttttgtaaaagcttatgcctctttggtatctatatctgtgaaagttttaatgatctgccataatgtcttggggacctttgtcttctgtgtaaatggtactagagaaaacacctatattatgagtcaatctagttggttttattcgacatgaaggaaatttccagataacaacactaacaaactctcccttgactagggggacaaagaaaagcaaaactgaccataaaaaacaattacctggtgagaagttgcataaacagaattaggtagtatattgaagacagcatcattaaacagttatgttgttctccttgcaaaaaacatgtactgacttcccgttgagtaatgccaagttgttttttttattataaaacttgcccttcattacatgtttcaaagtggtgtggtgggccaaaatattgaaatgatggaactgactgataaagctgtacaaataagcagtgtgcctaacaagcaacacagtaatgttgacatgcttaattcacaaatgctaatttcattataaattgttttgctaaaatacactttgaaactatttttctgtattccaagagctgagatcttagattttatgtagtattaagtgaaaaaatacgaaaataataaacattgaagaaaaaaaaaaaatgt

SEQ ID NO: 302237 - DNA, 6866 bp, Homo sapiens
  misc_feature (2546)..(2546): n is a, c, g, or t
tgccagggcgacgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggaacaaggaacaagggttcatagcatgcggtggtgaagatggattactgaaagttttgaaattagagacgcagacagatgatgcaaaattgaggggccttgcagcccccagtaacctttctatgaatcagactcttgaaggtcatagtggttctgttcaagttgtaacatggaatgagcagtatcagaagttgactaccagtgatgaaaacgggcttatcattgtgtggatgttatataaaggctcttggattgaggagatgatcaacaatcgaaataaatcagttgttcgcagtatgagctggaatgctgacggacagaagatctgcattgtatatgaagatggggctgtgatagttggttcagtggatggcaatcgtatttggggaaaagacctgaagggtatacagctatcccatgtaacatggtctgcggacagtaaagtcttactttttggaatggcaaatggggaaatacacatttacgataatcaaggaaattttatgataaaaatgaaactgagttgtttggtgaatgtcactggagctatcagcattgctggaattcattggtaccatggcacagaaggctacgtggagcctgattgcccttgccttgctgtttgctttgataatggaagatgccaaataatgagacatgagaatgaccaaaatcccgttttgattgacactggcatgtacgtagtaggcatccagtggaaccacatgggcagcgtgttagctgtggcaggcttccagaaggcagccatgcaggacaaagatgtgaacattgtgcagttttacactccgtttggtgagcatctgggtactttgaaagttcctggaaaggaaatatctgcactatcttgggaaggaggtggactgaaaattgcactagctgttgattcctttatatattttgcaaacattcgacctaattataagtggggttattgctcaaacactgtagtttatgcatataccagacctgatcgtccagaatattgtgttgtcttctgggatacgaaaaacaatgaaaaatatgttaaatatgtgaagggtctcatttctattactacctgtggagatttctgcattttggctacaaaagctgatgaaaatcatcctcagtaccattgtttgttgcaatgaccaaaacccatgtgatagcagcctcgaaagaagcattttatacctggcaatatcgtgtggcaaagaagctcacagcattggaaattaatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggaacccattcagacctctggatatatttgtaattttgaggatttagaaattaaatctgttcttttggatgagatattaaaggatccagaacatccaaacaaggattacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgangggttagagaaccttgccatttcacttccagaaaaccacaagttacttccagaaatagcacaaatgtttgtcagagttggaatgtgtgaacaagcagtgactgcatttttgaaatgtagtcaaccaaaggcagcagtagatacctgcgtacatctcaaccaatggaacaaagctgttgaattggctaaaaatcatagtatgaaagaaattggatctctgttagctaggtatgcatctcatttactggaaaagaataaaactcttgatgccatagaactctatcggaaagccaattacttttttgatgcagctaaactgatgtttaagattgcagatgaagaggcaaagaaaggaagtaaacctttacgtgtcaagaagctctatgtactgtcagccttacttatagagcaataccatgaacagatgaagaatgcccagcgaggaaaagttaaaggaaaaagttcagaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacagctcttcacctgaaagactatgaagacatcatccctcctgtggagatctactctctgctagcactctgcgcatgcgccagcagagcctttgggacttgttcaaaagctttcattaaacttaaatctttagagaccctcagttcagaacagaaacagcagtatgaagaccttgctttagaaatcttcaccaaacatacttcaaaagataacagaaaacctgaattggacagccttatggaaggtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgttaataaaataatttttatggcaatacaactgtgaaataataaggccgattttcatataaatgtatgaaaatcaaccatgttttctctcaccctctctcttttgtttatcttgtttttggttacatgataccatggaaatattccaaataaatttttttctcacagtgtcaaggtaactgaattcattaaaaaatcttgaagggagtagggagtgggggaagcatgggagtggggcaaagttgaatttagagaatttttataacccatgttacaaggaagttaaacaattgtaataatgaaatgagctttctctatagccatatttaattaaataagtgtcgaatgtcttctttattgtattttcagaagtgaggcgatggcattttaagacattttttacaatctgaattgtttctaatagccctattcttctattttaaaacctgtccttttagtctcatttaagagatggcatttggaatttacactttcatatgattgtgcagaaaacttgcctctatttataatgaagataacttaaacagaaatatccattttgtagttatagcttctgttgaaacattgtcactaagttggaccgtttatttacacaagtattgttgagggagtgattttttcttgatatgcgtctgttttcatttattattaatttgaaagataaacagttgtgatccataatggatcatttcttatgtcttttacatagctaataatgttctctgtttatttctcatgaattcccattttgtggctaaagaccagacctttgcactatttcatcaagattattttattgaggtttggcttacatatagtagaggcaatacatagagatacgcaactttgtttttgcagctacaatacactttctcaatctcatatgtttttgtcttgtagagacagagacaagttcagcatgttgcagattgggaatagtgagctatgagaagagatttagagcctagatgagcttaggatagagagtgggctcattggcctaaataaaaagagaagaccagaagtctttgaggtctctgtctctattcatgcgcctcgtggaaaattaccttggtacaatggtagcctctaaatagactgcctcgcaagctattccagaggtcatggaacagaaagccttataaaccaaataaaaattctcaaaatacattggtttattgaaccaatttgcaatacacagtgaggaacaaggagaaagcaatgatagattaacactgttagtgtaacgtgccagtggagtggaaagaccgcaacacctgaatcctgggttttgtaatgtttttatgtcctgactcacattctgtcacatacgctttcccctaatagtcgggttacaaaaaggaccagagtggccgcttgagccagatgactcaatcagatgaaatgtgcctgaggccaacgatgtacacttgctctatagaagggtgtcaggggcaagtacacttcaccacagcaatagcttgcctattagtctgctgagcagtcatgaattttattgtatttcttgggtaaggacaggccagaatgagtgtcaccagtgggtaattgaatcaacttctcacacatactgaaggctttatatgtctcatgcatacttagtgtatcatgaatatttggtatctttgtggcttttcatatttttagtgcttcatgaatatttggtatctcttgctcctttctatctgtggtcacacatacacgctctattaactttgcctaataagtctcctaggttactaacttacttacctaaatgtaacacaatgaattccagctttctcatttgttctataccagaatgggaaatttccccaaatcagaaaatcacatcctaacaaagaagtctgtctaagacagtacatctcctgttgaacttgcatctttccacaggactttctgtttttagggatgagactattctctgcttcatcaaggaaagagaaatgttcagggttgtagggatggcacacttattagttctgcctgtctgaaaggttcctgcaggacagtttggtcagagctgcaattcttagtccatggtctaatgcttgagtatctcttctttccctttcctgtctcaggaatcagctgagaattcattcgattgtcatgcctctagccccttactgtgatttgttggttgcactttcatttgctttagttctagaatcacctgttgactcctcagacttcacctaactttggaaactctcttttggaggcttctcatttccccctaattctgtgctgcctgagccctagaattttcccaccaacgaattattccaggtagatcctaagttgctggatctagttgatatttaaacaatatctagttgatatttctcattcagttggatccagaaaccagtatctctaaaaacaacctctcataccttgtggacctaattttgtgtgcgtgtgtgtgtgcgcgcatatgtatatagacaggcacatcttttttacttttgtaaaagcttatgcctctttggtatctatatctgtgaaagttttaatgatctgccataatgtcttggggacctttgtcttctgtgtaaatggtactagagaaaacacctatattatgagtcaatctagttggttttattcgacatgaaggaaatttccagataacaacactaacaaactctcccttgactagggggacaaagaaaagcaaaactgaccataaaaaacaattacctggtgagaagttgcataaacagaattaggtagtatattgaagacagcatcattaaacagttatgttgttctccttgcaaaaaacatgtactgacttcccgttgagtaatgccaagttgttttttttattataaaacttgcccttcattacatgtttcaaagtggtgtggtgggccaaaatattgaaatgatggaactgactgataaagctgtacaaataagcagtgtgcctaacaagcaacacagtaatgttgacatgcttaattcacaaatgctaatttcattataaattgttttgctaaaatacactttgaaactatttttctgtattccaagagctgagatcttagattttatgtagtattaagtgaaaaaatacgaaaataataaacattgaagaaaaaaaaaaaatgt

SEQ ID NO: 302238 - DNA, 4956 bp, Homo sapiens
  misc_feature (38)..(38): n is a, c, g, or t
  misc_feature (56)..(56): n is a, c, g, or t
  misc_feature (636)..(636): n is a, c, g, or t
ttaatagacgtttttgttttgacgagcccgccgcgtgntatgtttaagggtttggnaggattctgggatccagaacatccaaacaaggattacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgangggttagagaaccttgccatttcacttccagaaaaccacaagttacttccagaaatagcacaaatgtttgtcagagttggaatgtgtgaacaagcagtgactgcatttttgaaatgtagtcaaccaaaggcagcagtagatacctgcgtacatctcaaccaatggaacaaagctgttgaattggctaaaaatcatagtatgaaagaaattggatctctgttagctaggtatgcatctcatttactggaaaagaataaaactcttgatgccatagaactctatcggaaagccaattacttttttgatgcagctaaactgatgtttaagattgcagatgaagaggcaaagaaaggaagtaaacctttacgtgtcaagaagctctatgtactgtcagccttacttatagagcaataccatgaacagatgaagaatgcccagcgaggaaaagttaaaggaaaaagttcagaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacagctcttcacctgaaagactatgaagacatcatccctcctgtggagatctactctctgctagcactctgcgcatgcgccagcagagcctttgggacttgttcaaaagctttcattaaacttaaatctttagagaccctcagttcagaacagaaacagcagtatgaagaccttgctttagaaatcttcaccaaacatacttcaaaagataacagaaaacctgaattggacagccttatggaaggtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgttaataaaataatttttatggcaatacaactgtgaaataataaggccgattttcatataaatgtatgaaaatcaaccatgttttctctcaccctctctcttttgtttatcttgtttttggttacatgataccatggaaatattccaaataaatttttttctcacagtgtcaaggtaactgaattcattaaaaaatcttgaagggagtagggagtgggggaagcatgggagtggggcaaagttgaatttagagaatttttataacccatgttacaaggaagttaaacaattgtaataatgaaatgagctttctctatagccatatttaattaaataagtgtcgaatgtcttctttattgtattttcagaagtgaggcgatggcattttaagacattttttacaatctgaattgtttctaatagccctattcttctattttaaaacctgtccttttagtctcatttaagagatggcatttggaatttacactttcatatgattgtgcagaaaacttgcctctatttataatgaagataacttaaacagaaatatccattttgtagttatagcttctgttgaaacattgtcactaagttggaccgtttatttacacaagtattgttgagggagtgattttttcttgatatgcgtctgttttcatttattattaatttgaaagataaacagttgtgatccataatggatcatttcttatgtcttttacatagctaataatgttctctgtttatttctcatgaattcccattttgtggctaaagaccagacctttgcactatttcatcaagattattttattgaggtttggcttacatatagtagaggcaatacatagagatacgcaactttgtttttgcagctacaatacactttctcaatctcatatgtttttgtcttgtagagacagagacaagttcagcatgttgcagattgggaatagtgagctatgagaagagatttagagcctagatgagcttaggatagagagtgggctcattggcctaaataaaaagagaagaccagaagtctttgaggtctctgtctctattcatgcgcctcgtggaaaattaccttggtacaatggtagcctctaaatagactgcctcgcaagctattccagaggtcatggaacagaaagccttataaaccaaataaaaattctcaaaatacattggtttattgaaccaatttgcaatacacagtgaggaacaaggagaaagcaatgatagattaacactgttagtgtaacgtgccagtggagtggaaagaccgcaacacctgaatcctgggttttgtaatgtttttatgtcctgactcacattctgtcacatacgctttcccctaatagtcgggttacaaaaaggaccagagtggccgcttgagccagatgactcaatcagatgaaatgtgcctgaggccaacgatgtacacttgctctatagaagggtgtcaggggcaagtacacttcaccacagcaatagcttgcctattagtctgctgagcagtcatgaattttattgtatttcttgggtaaggacaggccagaatgagtgtcaccagtgggtaattgaatcaacttctcacacatactgaaggctttatatgtctcatgcatacttagtgtatcatgaatatttggtatctttgtggcttttcatatttttagtgcttcatgaatatttggtatctcttgctcctttctatctgtggtcacacatacacgctctattaactttgcctaataagtctcctaggttactaacttacttacctaaatgtaacacaatgaattccagctttctcatttgttctataccagaatgggaaatttccccaaatcagaaaatcacatcctaacaaagaagtctgtctaagacagtacatctcctgttgaacttgcatctttccacaggactttctgtttttagggatgagactattctctgcttcatcaaggaaagagaaatgttcagggttgtagggatggcacacttattagttctgcctgtctgaaaggttcctgcaggacagtttggtcagagctgcaattcttagtccatggtctaatgcttgagtatctcttctttccctttcctgtctcaggaatcagctgagaattcattcgattgtcatgcctctagccccttactgtgatttgttggttgcactttcatttgctttagttctagaatcacctgttgactcctcagacttcacctaactttggaaactctcttttggaggcttctcatttccccctaattctgtgctgcctgagccctagaattttcccaccaacgaattattccaggtagatcctaagttgctggatctagttgatatttaaacaatatctagttgatatttctcattcagttggatccagaaaccagtatctctaaaaacaacctctcataccttgtggacctaattttgtgtgcgtgtgtgtgtgcgcgcatatgtatatagacaggcacatcttttttacttttgtaaaagcttatgcctctttggtatctatatctgtgaaagttttaatgatctgccataatgtcttggggacctttgtcttctgtgtaaatggtactagagaaaacacctatattatgagtcaatctagttggttttattcgacatgaaggaaatttccagataacaacactaacaaactctcccttgactagggggacaaagaaaagcaaaactgaccataaaaaacaattacctggtgagaagttgcataaacagaattaggtagtatattgaagacagcatcattaaacagttatgttgttctccttgcaaaaaacatgtactgacttcccgttgagtaatgccaagttgttttttttattataaaacttgcccttcattacatgtttcaaagtggtgtggtgggccaaaatattgaaatgatggaactgactgataaagctgtacaaataagcagtgtgcctaacaagcaacacagtaatgttgacatgcttaattcacaaatgctaatttcattataaattgttttgctaaaatacactttgaaactatttttctgtattccaagagctgagatcttagattttatgtagtattaagtgaaaaaatacgaaaataataaacattgaagaaaaaaaaaaaatgt

SEQ ID NO: 302239 - DNA, 1533 bp, Homo sapiens
tgccagggcgacgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggaacaaggaacaagggttcatagcatgcggtggtgaagatggattactgaaagttttgaaattagagacgcagacagatgatgcaaaattgaggggccttgcagcccccagtaacctttctatgaatcagactcttgaaggtcatagtggttctgttcaagttgtaacatggaatgagcagtatcagaagttgactaccagtgatgaaaacgggcttatcattgtgtggatgttatataaaggctcttggattgaggagatgatcaacaatcgaaataaatcagttgttcgcagtatgagctggaatgctgacggacagaagatctgcattgtatatgaagatggggctgtgatagttggttcagtggatggcaatcgtatttggggaaaagacctgaagggtatacagctatcccatgtaacatggtctgcggacagtaaagtcttactttttggaatggcaaatggggaaatacacatttacgataatcaaggaaattttatgataaaaatgaaactgagttgtttggtgaatgtcactggagctatcagcattgctggaattcattggtaccatggcacagaaggctacgtggagcctgattgcccttgccttgctgtttgctttgataatggaagatgccaaataatgagacatgagaatgaccaaaatcccgttttgattgacactggcatgtacgtagtaggcatccagtggaaccacatgggcagcgtgttagctgtggcaggcttccagaaggcagccatgcaggacaaagatgtgaacattgtgcagttttacactccgtttggtgagcatctgggtactttgaaagttcctggaaaggaaatatctgcactatcttgggaaggaggtggactgaaaattgcactagctgttgattcctttatatattttgcaaacattcgacctaattataagtggggttattgctcaaacactgtagtttatgcatataccagacctgatcgtccagaatattgtgttgtcttctgggatacgaaaaacaatgaaaaatatgttaaatatgtgaagggtctcatttctattactacctgtggagatttctgcattttggctacaaaagctgatgaaaatcatcctcaggtaggtgtttcttgatatcttaagacatagctgggctaactgcttgggttatagttttctaccttttcaagcatggcctctacactggcaagtacatcaaaacattgggtctgttggcactattggtctagaccaattttggaaaactctgtgactccattgatgctgtgtccctgattttttttttcttcaagcagctaatcttatggcaattcatactgactggtt

SEQ ID NO: 302240 - DNA, 1952 bp, Homo sapiens
tgccagggcgacgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggaacaaggaacaagggttcatagcatgcggtggtgaagatggattactgaaagttttgaaattagagacgcagacagatgatgcaaaattgaggggccttgcagcccccagtaacctttctatgaatcagactcttgaaggtcatagtggttctgttcaagttgtaacatggaatgagcagtatcagaagttgactaccagtgatgaaaacgggcttatcattgtgtggatgttatataaaggctcttggattgaggagatgatcaacaatcgaaataaatcagttgttcgcagtatgagctggaatgctgacggacagaagatctgcattgtatatgaagatggggctgtgatagttggttcagtggatggcaatcgtatttggggaaaagacctgaagggtatacagctatcccatgtaacatggtctgcggacagtaaagtcttactttttggaatggcaaatggggaaatacacatttacgataatcaaggaaattttatgataaaaatgaaactgagttgtttggtgaatgtcactggagctatcagcattgctggaattcattggtaccatggcacagaaggctacgtggagcctgattgcccttgccttgctgtttgctttgataatggaagatgccaaataatgagacatgagaatgaccaaaatcccgttttgattgacactggcatgtacgtagtaggcatccagtggaaccacatgggcagcgtgttagctgtggcaggcttccagaaggcagccatgcaggacaaagatgtgaacattgtgcagttttacactccgtttggtgagcatctgggtactttgaaagttcctggaaaggaaatatctgcactatcttgggaaggaggtggactgaaaattgcactagctgttgattcctttatatattttgcaaacattcgacctaattataagtggggttattgctcaaacactgtagtttatgcatataccagacctgatcgtccagaatattgtgttgtcttctgggatacgaaaaacaatgaaaaatatgttaaatatgtgaagggtctcatttctattactacctgtggagatttctgcattttggctacaaaagctgatgaaaatcatcctcagtaccattgtttgttgcaatgaccaaaacccatgtgatagcagcctcgaaagaagcattttatacctggcaatatcgtgtggcaaagaagctcacagcattggaaattaatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggtaaaaacaagaaatgagtgttaacagtctataaataatgagccaaatataaaaacc

SEQ ID NO: 302241 - DNA, 655 bp, Homo sapiens
gtgttaaacttcctaatttgtaatatgattatggaagagaatgtctttatttttaggaaatgtacactaaagtatttagggattaaaaaattaaaagtcatcaattattcacgtaccctagaggtttaagatatgctcaagagtgttttactaatagaatggaaaacgagtgagaggtgggcagaagagagattataggacatatctaccaaaaatgataaaagtcccctaaacaagtacttgttatggtgtcctttgaacatcattatttttgggagtcaggccaattgagtaaaccatgcttgtatttgtttctgtcatcaggtatatggtagttctggtagctagccatgattggtgtctttactgggatgaaatagggatagatatgaaaaatagtattatgcattgttgtagaaaattagtgatatcaataactgcatcttatgaataggttttgaggaatattaaagactagttagctgtacaggaaccatattgattttaacatgatcttggtgtttatataaaaatgtgaatttgaaattaattgtaacctttaagtttctaaattgttttataatgttctaggttctgttcaagttgtaacatggaatgagcagtatcagaagttgactaccagtgatgaaaacgg

SEQ ID NO: 302242 - DNA, 522 bp, Homo sapiens
  misc_feature (33)..(33): n is a, c, g, or t
gctgaatgttactatatgttagaggattatgangggttagagaaccttgccatttcacttccagaaaaccacaagttacttccagtaggtattgcaaattttagtttttggaattgttaggttactttataaaattttatgttatagtcaggaaatatctcccacaataaagaaaattaaaaatctataatgttacagtttcttagacatggaatgatgcttttaattataaagtaatatataaataatatagaatgcttgaaaatggaggaggaaaagtcagtcacattcttactactttaatatgatcacagtcttgtgtagtctgttaagatttataaagttactttttaaatgttagctgaatacatgaaatatttacagatgaaatgatatgttgctagggatttgcttcaaaataatctgaaattgtttgaaatttgctataacttaagtttaaaaagatagctcaacttttattatgttatattaacaataaagtatttcaagttaaaagagaaa

SEQ ID NO: 302243 - DNA, 1169 bp, Homo sapiens
tccccgcccaccggcaagtcacatgagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgta

SEQ ID NO: 302244 - DNA, 1206 bp, Homo sapiens
tccccgcccaccggcaagtcacatgagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaa

SEQ ID NO: 302245 - DNA, 1173 bp, Homo sapiens
  misc_feature (18)..(18): n is a, c, g, or t
gtatcaacgcagagtgcnattacggccggggagaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgta

SEQ ID NO: 302246 - DNA, 1241 bp, Homo sapiens
tccccgcccaccggcaagtcacatgagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaaaatgtctctattgcccacacgggggactctgggccattccttttaagagggaattaatgaccgctctccac

SEQ ID NO: 302247 - DNA, 997 bp, Homo sapiens
tccccgcccaccggcaagtcacatgagccaccaaaatggtggtgttcgggtatgaggctgggactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgta

SEQ ID NO: 302248 - DNA, 1034 bp, Homo sapiens
tccccgcccaccggcaagtcacatgagccaccaaaatggtggtgttcgggtatgaggctgggactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaa

SEQ ID NO: 302249 - DNA, 1130 bp, Homo sapiens
  misc_feature (1110)..(1110): n is a, c, g, or t
tccccgcccaccggcaagtcacatgagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttaaaaaaaatagaaaaaaaatacctacattgcctcgngtgtggcctcgttggcctca

SEQ ID NO: 302250 - DNA, 1137 bp, Homo sapiens
  misc_feature (1080)..(1080): n is a, c, g, or t
tccccgcccaccggcaagtcacatgagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttccgttngcgcgccaagccttcctccccctctctcgaccccgcgttacaatccgctcggatccc

SEQ ID NO: 302251 - DNA, 1472 bp, Homo sapiens
tccccgcccaccggcaagtcacatgagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaaaagttcttccttttccttcttttttcttttcttttcttttcttttttttttttttttttaaggttaataaactctctttcttctttagctgtctatgatatatttgaatcaaaatgtggtagtttggtatttcagatagctaacttttaacttttttgctctctacattatagatctagaaaggcaattatcaatttaggagaagtcaacaaacttctaatagcattcatatccaggagaggtgattaactcttttttctttttaggtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaa

SEQ ID NO: 302252 - DNA, 1131 bp, Homo sapiens
  misc_feature (18)..(18): n is a, c, g, or t
gtatcaacgcagagtgcnattacggccggggagaccaaaatggtggtgttcgggtatgaggctgggactaagccaagggattcaggtgtggtgccggtgggaactgaggaagcgcccaagctttttgttctgaactcccactgcgttgtggattcctgaggatgggatgactgtatcttgattacccggaggtctggcatataccacgtgctccctaaattatgagcgaatgttgaataaaattctaaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgta

SEQ ID NO: 302253 - DNA, 1435 bp, Homo sapiens
tccccgcccaccggcaagtcacatgagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaaaagttcttccttttccttcttttttcttttcttttcttttcttttttttttttttttttaaggttaataaactctctttcttctttagctgtctatgatatatttgaatcaaaatgtggtagtttggtatttcagatagctaacttttaacttttttgctctctacattatagatctagaaaggcaattatcaatttaggagaagtcaacaaacttctaatagcattcatatccaggagaggtgattaactcttttttctttttaggtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgta

SEQ ID NO: 302254 - DNA, 1303 bp, Homo sapiens
  misc_feature (18)..(18): n is a, c, g, or t
gtatcaacgcagagtgcnattacggccggggagaccaaaatggtggtgttcgggtatgaggctgggactaagccaagggattcaggtgtggtgccggtgggaactgaggaagcgcccaagctttttgttctgaactcccactgcgttgtggattcctgaggatgggatgactgtatcttgattacccggaggtctggcatataccacgtgctccctaaattatgagcgaatgttgaataaaattctaaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgta

SEQ ID NO: 302255 - DNA, 1072 bp, Homo sapiens
  misc_feature (18)..(18): n is a, c, g, or t
gtatcaacgcagagtgcnattacggccggggagaccaaaatggtggtgttcgggtatgaggctgggactaagccaagggattcaggtgtggtgccggtgggaactgaggaagcgcccaagctttttgttctgaactcccactgcgttgtggattcctgaggatgggatgactgtatcttgattacccggaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgta

SEQ ID NO: 302256 - DNA, 879 bp, Homo sapiens
  misc_feature (18)..(18): n is a, c, g, or t
gtatcaacgcagagtgcnattacggccggggagaccaaaatggtggtgttcgggtatgaggctgggactaagccaagggattcaggtgtggtgccggtgggaactgaggaagcgcccaaggacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgta

SEQ ID NO: 302257 - DNA, 965 bp, Homo sapiens
  misc_feature (54)..(54): n is a, c, g, or t
  misc_feature (69)..(69): n is a, c, g, or t
  misc_feature (75)..(75): n is a, c, g, or t
  misc_feature (131)..(131): n is a, c, g, or t
  misc_feature (133)..(133): n is a, c, g, or t
  misc_feature (136)..(136): n is a, c, g, or t
  misc_feature (139)..(139): n is a, c, g, or t
  misc_feature (149)..(150): n is a, c, g, or t
  misc_feature (152)..(152): n is a, c, g, or t
  misc_feature (159)..(159): n is a, c, g, or t
  misc_feature (162)..(162): n is a, c, g, or t
  misc_feature (169)..(169): n is a, c, g, or t
  misc_feature (177)..(177): n is a, c, g, or t
  misc_feature (182)..(182): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (200)..(200): n is a, c, g, or t
  misc_feature (203)..(203): n is a, c, g, or t
cccacctttatatctattattacaactacatatatcctcacttccttctcttanttattatatattaanacatcnacattttcatttttcaatatttcatcatctattcattttcatcccattccttctcnanaanatncaaaactcannanaccaatntanatataanacatatantattntttngactgncanagaanagnaaagacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgta

SEQ ID NO: 302258 - DNA, 828 bp, Homo sapiens
ttcagaggatccccctttggggtcttgctggcactcatgaaaaaaatttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgta

SEQ ID NO: 302259 - DNA, 1102 bp, Homo sapiens
  misc_feature (18)..(18): n is a, c, g, or t
gtatcaacgcagagtgcnattacggccggggagaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgctataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaa

SEQ ID NO: 302260 - DNA, 1304 bp, Homo sapiens
  misc_feature (18)..(18): n is a, c, g, or t
gtatcaacgcagagtgcnattacggccggggagaccaaaatggtggtgttcgggtatgaggctgggactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaaaagttcttccttttccttcttttttcttttcttttcttttcttttttttttttttttttaaggttaataaactctctttcttctttagctgtctatgatatatttgaatcaaaatgtggtagtttggtatttcagatagctaacttttaacttttttgctctctacattatagatctagaaaggcaattatcaatttaggagaagtcaacaaacttctaatagcattcatatccaggagaggtgattaactcttttttctttttaggtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaa

SEQ ID NO: 302261 - DNA, 808 bp, Homo sapiens
  misc_feature (18)..(18): n is a, c, g, or t
gtatcaacgcagagtgcnattacggccggggagaccaaaatggtggtgttcgggtatgaggctgggactaagccaagggattcaggtgtggtgccggtgggaactgaggaagcgcccaaggacacaaaatatatatcaaatggcgacatttggaacaacagctggtttctctggaatattctcaaacttcctgttcagacgctgctataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaa

SEQ ID NO: 302262 - DNA, 1198 bp, Homo sapiens
ataaaaatgtattaacctagaatccaggtctggtttgctagtttagtattgtcattataaaattgtttctggctgggcacggtggctcatgcctataatcccaacactttgggaggccaagacaggcagatcacttgaggtcaggagttcgagaccagcctggccaacacagtctctactaaaaatagaaaaacagttgagcatggtggtgcaagcttataatcccagctacttgggaggctgaggcatgagaattgcttgaaccctggaggcagaggttgcagtgagccgagatcgtgccactgtactctagcctgggcaacagagtgagactccgtctccaaaaaataaaataaaattgcttctacaacaaccacatacgttagaggtaattctctatgtgataaagtataataaaaactttttaaaatgtgctgcatttggcctgttatatgccacagagtttgaatttctaatattctttctatggtttagttgtggttgaggatagtgcagataactactctgtgaggtacaacactgtcttaatagctcttgagttttaaaggaaaaccaaatttacttttgttttccagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaa

SEQ ID NO: 302263 - DNA, 1464 bp, Homo sapiens
ataaaaatgtattaacctagaatccaggtctggtttgctagtttagtattgtcattataaaattgtttctggctgggcacggtggctcatgcctataatcccaacactttgggaggccaagacaggcagatcacttgaggtcaggagttcgagaccagcctggccaacacagtctctactaaaaatagaaaaacagttgagcatggtggtgcaagcttataatcccagctacttgggaggctgaggcatgagaattgcttgaaccctggaggcagaggttgcagtgagccgagatcgtgccactgtactctagcctgggcaacagagtgagactccgtctccaaaaaataaaataaaattgcttctacaacaaccacatacgttagaggtaattctctatgtgataaagtataataaaaactttttaaaatgtgctgcatttggcctgttatatgccacagagtttgaatttctaatattctttctatggtttagttgtggttgaggatagtgcagataactactctgtgaggtacaacactgtcttaatagctcttgagttttaaaggaaaaccaaatttacttttgttttccagataatataagcaaggaaaactgtgttttcagaagctcactgattggcatagtttgtggtgttttctatcccagttctttggcttttactaaaaatggacgcctggcaaccaaaagttcttccttttccttcttttttcttttcttttcttttcttttttttttttttttttaaggttaataaactctctttcttctttagctgtctatgatatatttgaatcaaaatgtggtagtttggtatttcagatagctaacttttaacttttttgctctctacattatagatctagaaaggcaattatcaatttaggagaagtcaacaaacttctaatagcattcatatccaggagaggtgattaactcttttttctttttaggtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaa

SEQ ID NO: 302264 - DNA, 948 bp, Homo sapiens
tccccgcccaccggcaagtcacatgagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcaggtgaatttaaattcactaatgtataacgtagttatgtctaagtaaagttacttattaacatatactgttgctactgctaataataattctttacatttatatattgctatacagtttacaaagtccatataccttgtcatatttaatccctgcaacaatcctcctaatcaggtaaactgtatttttttatttctgtagataagcaacccaaactgaggcatgttcaagtacgctaataagcaacatactgggaaaagaattggctgtggcatacaacgcacatcatttcagtatgctacctcctgccacttaagttttgtgacattcagtaaggcatttcatct

SEQ ID NO: 302265 - DNA, 855 bp, Homo sapiens
  misc_feature (18)..(18): n is a, c, g, or t
gtatcaacgcagagtgcnattacggccggggagaccaaaatggtggtgttcgggtatgaggctgggactaagccaagggattcaggtgtggtgccggtgggaactgaggaagcgcccaaggacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaacaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaa

SEQ ID NO: 302266 - DNA, 1139 bp, Homo sapiens
  misc_feature (18)..(18): n is a, c, g, or t
gtatcaacgcagagtgcnattacggccggggagaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatatttcaaggttaaacatgatgctttgaagacatatgcatcattggctacacttccatttttgtctactgttgttaaatttacttttgttttccagataatataagcaaggaaaactgtgttttcagaagctcactgattggcatagtttgtggttttggcttttactaaaaatggacgcctggcaaccaagtatcataccgttccactgccaccaaaaggaagggttttaatccattggatgacgctttgtaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaa

SEQ ID NO: 302267 - DNA, 910 bp, Homo sapiens
  misc_feature (18)..(18): n is a, c, g, or t
gtatcaacgcagagtgcnattacggccggggagaccaaaatggtggtgttcgggtatgaggctgggactaagccaagggattcaggtgtggtgccggtgggaactgaggaagcgcccaagctttttgttctgaactcccactgcgttgtggattcctgaggatgggatgactgtatcttgattacccggaggtctggcatataccacgtgctccctaaattatgagcgaatgttgaataaaattctaaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcaggtgaatttaaattcactaatgtataacgtagttatgtctaagtaaagttacttattaacatatactgttgctactgctaataataattctttacatttatatattgctatacagtttacaaagtccatataccttgtcatatttaatccctgcaacaatcctcctaatcaggtaaactgtatttttttatttctgtagataagcaacccaaactgaggcatgttcaagtacgctaataagcaacatactgggaaaagaattggctgtggcatacaacgcacatcatttcagtatgctacctcctgccacttaagttttgtgacattcagtaaggcatttcatct

SEQ ID NO: 302268 - DNA, 780 bp, Homo sapiens
  misc_feature (18)..(18): n is a, c, g, or t
gtatcaacgcagagtgcnattacggccggggagaccaaaatggtggtgttcgggtatgaggctgggactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcaggtgaatttaaattcactaatgtataacgtagttatgtctaagtaaagttacttattaacatatactgttgctactgctaataataattctttacatttatatattgctatacagtttacaaagtccatataccttgtcatatttaatccctgcaacaatcctcctaatcaggtaaactgtatttttttatttctgtagataagcaacccaaactgaggcatgttcaagtacgctaataagcaacatactgggaaaagaattggctgtggcatacaacgcacatcatttcagtatgctacctcctgccacttaagttttgtgacattcagtaaggcatttcatct

SEQ ID NO: 302269 - DNA, 399 bp, Homo sapiens
  misc_feature (18)..(18): n is a, c, g, or t
gtatcaacgcagagtgcnattacggccggggagaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagtatgttagccttctacactaaatctcaagcaagccaacctttcagaccttcagtttgctcatatgtatagaaataatcattatactaccatttctcaagttagtgt

SEQ ID NO: 302270 - DNA, 584 bp, Homo sapiens
agactcttctaagatgatacctttaaaggagatttgaaaagttaaaacagctcccaagtccatgcaaggagcagtcgattaagtctccagttgctgtggaaagaggcggagagaacgtagatgacctaaattctagtcctcattatctgcagtttgttttctcttgtctccaggcctttgcacaggctttttcttcaacttggagtatttccctgcttctatccgtcccaactcccctgccaaactgttctctttcggttattgatttaaatgtcacttcttccgggaagccttcccacgcttcctctggctagattgtttgctttttcttaggttgttgggtttttcgtttatgtcactctctcattctgtgtttaaattgccagctttttgttctgaactcccactgcgttgtggattcctgaggatgggatgactgtatcttgattacccggaggtctggcatataccacgtgctccctaaattatgagcgaatgttgaataaaattctaaaggtgaaatttattattaggtgaaaaatttattattaggtaaaataatacacatgaaagcactacaaaac

SEQ ID NO: 302271 - DNA, 1504 bp, Homo sapiens
ggaaacaaaagagtctcgccggcgtccccgcccgcacactcgcgcacactcgcgctcgggcgcacacggagcagggaccggcgcccggagcgagccagggagcggctaaccggggacccaccgcgcggagccagcctagctgccagcgagcccaacccgcgacgacccacgcccctgagccccgcagccgacccctgccggccggtgtccccaccgccatccctgacccatggcgctgaagaggattcagaaagaattgagtgatctacagcgcgatccacctgctcactgttcagctggacctgtgggagatgacttgttccactggcaagccactattatggggcctcctgatagcgcatatcaaggtggagtcttctttctcactgtacattttccgacagattatccttttaaaccaccaaagattgctttcacaacaaaaatttaccatccaaacataaacagtaatggaagtatttgtctcgatattctgaggtcacaatggtcaccagctctgactgtatcaaaagttttattgtccatatgttctctactttgtgatcctaatccagatgaccccttagtaccagatattgcacaaatctataaatcagacaaagaaaaatacaacagacatgcaagagaatggactcagaaatatgcaatgtaaaaatcaaaaacattttcatatataccagagtactgtaaaatctaggtttttttcaacattagcagtaaattgagcactgtttactgtttcattgtaccatgaaaccatttgatttttacccattttaaatgtgtttctgaagcaagacaaaacaaacttccaaaaatacccttaagactgtgatgagagcatttatcattttgtatgcattgagaaagacatttattatggtttttaagatacttggacatctgcatcttcagcttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtatttttttactgtatagactaaatatattctatttacatgtatgtcaactcattacttttttcctgtgaacagtattgaaaaaccccaacggctgataattaagtgaattaactgtgtctcccttgtcttaggatattctgtagattgattgcagatttcttaaatctgaaatgatctttacactgtaattctcagcatactgattatggagaaacacttgttttgattttgttatacttgacttaactttattgcaatgtgaattaattgcactgctaagtaggaagatgtgtaacttttatttgttgctattcacatttgaattttttcctgtataggcaatattatattgacaccttttacagatcttactgtagctttttccatataaataaaatgctttttctacta

SEQ ID NO: 302272 - DNA, 2668 bp, Homo sapiens
ggaaacaaaagagtctcgccggcgtccccgcccgcacactcgcgcacactcgcgctcgggcgcacacggagcagggaccggcgcccggagcgagccagggagcggctaaccggggacccaccgcgcggagccagcctagctgccagcgagcccaacccgcgacgacccacgcccctgagccccgcagccgacccctgccggccggtgtccccaccgccatccctgacccatggcgctgaagaggattcagaaagaattgagtgatctacagcgcgatccacctgctcactgttcagctggacctgtgggagatgacttgttccactggcaagccactattatggggcctcctgatagcgcatatcaaggtggagtcttctttctcactgtacattttccgacagattatccttttaaaccaccaaagattgctttcacaacaaaaatttaccatccaaacataaacagtaatggaagtatttgtctcgatattctgaggtcacaatggtcaccagctctgactgtatcaaaagttttattgtccatatgttctctactttgtgatcctaatccagatgaccccttagtaccagatattgcacaaatctataaatcagacaaagaaaaatacaacagacatgcaagagaatggactcagaaatatgcaatgtaaaaatcaaaaacattttcatatataccagagtactgtaaaatctaggtttttttcaacattagcagtaaattgagcactgtttactgtttcattgtaccatgaaaccatttgatttttacccattttaaatgtgtttctgaagcaagacaaaacaaacttccaaaaatacccttaagactgtgatgagagcatttatcattttgtatgcattgagaaagacatttattatggtttttaagatacttggacatctgcatcttcagcttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtatttttttactgtatagactaaatatattctatttacatgtatgtcaactcattacttttttcctgtgaacagtattgaaaaaccccaacggctgataattaagtgaattaactgtgtctcccttgtcttaggatattctgtagattgattgcagatttcttaaatctgaaatgatctttacactgtaattctcagcatactgattatggagaaacacttgttttgattttgttatacttgacttaactttattgcaatgtgaattaattgcactgctaagtaggaagatgtgtaacttttatttgttgctattcacatttgaattttttcctgtataggcaatattatattgacaccttttacagatcttactgtagctttttccatataaataaaatgctttttctactatttgtcttgattacttaaaaaaataaaaatataagtaaggatcaaaactctaaaattttgcatgaaaattacatccaaattgtgaaaatcagatctattttgttgccattagtcaccattagttatataaattttattgttttaggttagtatctctttactaaattgtcagtctataagataatatatgttgatcccttgctgtagaggagaatttagagtaatttggggtttgtcttggattatatctaaatggattatttgttaaaagtactgaaatgagtataaggcagtatcacccatccaaaagaaaggtctttatagacctgcacagtcactagattaattcattaaaatgcccccaccctgatgtaattgacattacatttcttaacattttaaaatctagaatttctaaaatggaatttaatgccatcacaatttgaaaaactttttttttttttttactatagaagttacaaaggaagttctaaaattatgcctccctctgtttttataagtggccatcgaaaagtgatttaaataagcaggttatctttatagattttaaagaaaactagaaagttttcaatgttttaactgggggaaaaatacatctctttaatgtttagcatgcttgtcaaccttgagtgagtgtcatttttaagaacagttgtagcccttctgattatggcagtagctgtagaagtatgtaagaatatgtgatgggtgtagtcattagcaaagcatttaaatcacttgagtattttgtcatggttcattattattaaagcacaaaataacctattgttagaaaatatgtgtttttataaatgaatgtaaaataattaaatgaattgtgaaatggatgtttaagaaaatataggcttaaaaagtaaatctataaaatgatgtcttaaaacagccatatcatgaaaaattctacttagctatattattataagctacatttgccctgaatttgaacactcaacatcactagatttaaatatttagtatattttgatagtaaagggttttgtttcttgaatatcttcactttaaacaaaaaaaaaaacaactttcatttgtgtggcatttatttttggaagtgtcttcttttttttctttattaaagtttttgaaacttgcctaacttgtttg

SEQ ID NO: 302273 - DNA, 1393 bp, Homo sapiens
ttatacagacataagtatacagcttgaccaatttttacaaagtgaacaaacctgtgaaaccagcacccagctcaagaaatagtattacaaggaccctagaaaccctttcttctcccttcttagctttacctctgtcgtcaaggaattgagtgatctacagcgcgatccacctgctcactgttcagctggacctgtgggagatgacttgttccactggcaagccactattatggggcctcctgatagcgcatatcaaggtggagtcttctttctcactgtacattttccgacagattatccttttaaaccaccaaagattgctttcacaacaaaaatttaccatccaaacataaacagtaatggaagtatttgtctcgatattctgaggtcacaatggtcaccagctctgactgtatcaaaagttttattgtccatatgttctctactttgtgatcctaatccagatgaccccttagtaccagatattgcacaaatctataaatcagacaaagaaaaatacaacagacatgcaagagaatggactcagaaatatgcaatgtaaaaatcaaaaacattttcatatataccagagtactgtaaaatctaggtttttttcaacattagcagtaaattgagcactgtttactgtttcattgtaccatgaaaccatttgatttttacccattttaaatgtgtttctgaagcaagacaaaacaaacttccaaaaatacccttaagactgtgatgagagcatttatcattttgtatgcattgagaaagacatttattatggtttttaagatacttggacatctgcatcttcagcttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtatttttttactgtatagactaaatatattctatttacatgtatgtcaactcattacttttttcctgtgaacagtattgaaaaaccccaacggctgataattaagtgaattaactgtgtctcccttgtcttaggatattctgtagattgattgcagatttcttaaatctgaaatgatctttacactgtaattctcagcatactgattatggagaaacacttgttttgattttgttatacttgacttaactttattgcaatgtgaattaattgcactgctaagtaggaagatgtgtaacttttatttgttgctattcacatttgaattttttcctgtataggcaatattatattgacaccttttacagatcttactgtagctttttccatataaataaaatgctttttctacta

SEQ ID NO: 302274 - DNA, 2207 bp, Homo sapiens
ggaaacaaaagagtctcgccggcgtccccgcccgcacactcgcgcacactcgcgctcgggcgcacacggagcagggaccggcgcccggagcgagccagggagcggctaaccggggacccaccgcgcggagccagcctagctgccagcgagcccaacccgcgacgacccacgcccctgagccccgcagccgacccctgccggccggtgtccccaccgccatccctgacccatggcgctgaagaggattcagaaagaattgagtgatctacagcgcgatccacctgctcactgttcagctggacctgtgggagatgacttgttccactggcaagccactattatggggcctcctgatagcgcatatcaaggtggagtcttctttctcactgtacattttccgacagattatccttttaaaccaccaaagattgctttcacaacaaaaatttaccatccaaacataaacagtaatggaagtatttgtctcgatattctgaggtcacaatggtcaccagctctgactgtatcaaaagttttattgtccatatgttctctactttgtgatcctaatccagatgaccccttagtaccagatattgcacaaatctataaatcagacaaagaaaagtaagtgtttacttattttagtttctgtatggatacattcctatatagtatgccaaaacacgaatattatcaatatgttttaagtcaatttgattatggttgttatatgtatattgtttatctttttccaatggagtaaacctttctttgagaactctgttagaccttttatgataaatcttgttccttcccacttactgttcaatagtatatactctgtatttgaaaaatagatgtatatattctaggtgataaattaaaaatgaaagaatttaatcattggaaagtattaaatatatattgcttatcttctccaaggaagaggagttctctcgtacccatccaaactgacctaattctcaagctgcttcatcttgctagtactgtaggttcatttgcaatttgtagataatgctccttcaggattggcttttgtaaatttctgttagaagctggtttctgcattttgatttttgtgtatttggatacattttcatataggttgcagagaaatccatgagttaaaaaattatttttcctgttttatttctgcatgaacctaagtcacattgacccagtaattgatatatgtgtgattattgcaattaagtataagaaggtagaatatatagttttattagacagatgcttctgaaatattaattttgtatgtttttactatatcctttttgtgtatctacagatacaacagacatgcaagagaatggactcagaaatatgcaatgtaaaaatcaaaaacattttcatatataccagagtactgtaaaatctaggtttttttcaacattagcagtaaattgagcactgtttactgtttcattgtaccatgaaaccatttgatttttacccattttaaatgtgtttctgaagcaagacaaaacaaacttccaaaaatacccttaagactgtgatgagagcatttatcattttgtatgcattgagaaagacatttattatggtttttaagatacttggacatctgcatcttcagcttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtatttttttactgtatagactaaatatattctatttacatgtatgtcaactcattacttttttcctgtgaacagtattgaaaaaccccaacggctgataattaagtgaattaactgtgtctcccttgtcttaggatattctgtagattgattgcagatttcttaaatctgaaatgatctttacactgtaattctcagcatactgattatggagaaacacttgttttgattttgttatacttgacttaactttattgcaatgtgaattaattgcactgctaagtaggaagatgtgtaacttttatttgttgctattcacatttgaattttttcctgtataggcaatattatattgacaccttttacagatcttactgtagctttttccatataaataaaatgctttttctacta

SEQ ID NO: 302275 - DNA, 1392 bp, Homo sapiens
agccatggttaattactttagatgctgctcaaccagtcataccggctactagagacttatttattacactgtccaaaatactcttcagttcctttgagggcaaaagaaggaagctgacttgtttgtgttcacattctcactagctagaactgtgtgtagcacaaagtagataattatttgatttgtgttgatgacttttctcctctaaagttatgtaaagttgaggatattttaccctagagcaaattggttctgttttattcatagttgattcaaaggtgattgtcatattttgttgttttgttttatgtttagattgctttcacaacaaaaatttaccatccaaacataaacagtaatggaagtatttgtctcgatattctgaggtcacaatggtcaccagctctgactgtatcaaaagttttattgtccatatgttctctactttgtgatcctaatccagatgaccccttagtaccagatattgcacaaatctataaatcagacaaagaaaaatacaacagacatgcaagagaatggactcagaaatatgcaatgtaaaaatcaaaaacattttcatatataccagagtactgtaaaatctaggtttttttcaacattagcagtaaattgagcactgtttactgtttcattgtaccatgaaaccatttgatttttacccattttaaatgtgtttctgaagcaagacaaaacaaacttccaaaaatacccttaagactgtgatgagagcatttatcattttgtatgcattgagaaagacatttattatggtttttaagatacttggacatctgcatcttcagcttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtatttttttactgtatagactaaatatattctatttacatgtatgtcaactcattacttttttcctgtgaacagtattgaaaaaccccaacggctgataattaagtgaattaactgtgtctcccttgtcttaggatattctgtagattgattgcagatttcttaaatctgaaatgatctttacactgtaattctcagcatactgattatggagaaacacttgttttgattttgttatacttgacttaactttattgcaatgtgaattaattgcactgctaagtaggaagatgtgtaacttttatttgttgctattcacatttgaattttttcctgtataggcaatattatattgacaccttttacagatcttactgtagctttttccatataaataaaatgctttttctacta

SEQ ID NO: 302276 - DNA, 3231 bp, Homo sapiens
cgctgctctgcggggaggcgggcgctcccgcaggggttcctccaagatggcggcgcagaggaggagcttgctgcagagtgagcagcagccaagctggacagatgacctgcctctctgccacctctctggggttggctcagcctccaaccgcagctactctgctgatggcaagggcactgagagccacccgccagaggacagctggctcaagttcaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaccaaagcccgaccttaaccctgcagtccaccaacacgcacacgcagagcagcagctccagctctgacggaggcctcttccgctcccggcccgcccactcgctcccgcctggcgaggacggtcgtgttgagccctatgtggactttgctgagttttaccgcctctggagcgtggaccatggcgagcagagcgtggtgacagcaccgtagggcagccggagaatgcagcccaagcagggcctggcatggggcaggacagggtccagccttttcctaacatctgcctgtgccacaacggccagcaggtgccccatcctctgcccacagcagactctgtcccatggctctccgggcagtagagtgtgtgagtgcagactggacctgtggttcataccttgtcaccacccgggaagctgaaggccacttcctcccagatggcctcagccaggaccatcgccctttctcagagcagagggccaggtatagaaaccgcagtgggcctgcaagccgcccgagcctccccagcagcctcctacagagcaggaagaggcgccctgtgaaccctgagtgttgcaggcccagcagaccctgctgtcccaagcccacccctcctcccaccatcacctccctcacctcgggacagtagccctccacttctccagcctctcagccctgtgctcctgcatccagagtggaacccaggctggtgtccgcatctgtccctgggccccacccctggacctgccttggttgtgtcatctgttgtaaacattcaggaggaccagggcagcatctggggcctgggatggccacagaaggggcaggccaggtggaaaggagccagggggaagtggtctaagagacctggaactgccagaggatggcggcctgggcttccccagagccaggcgtgcgggagaggtgaggactggccccggtgggctgaggcaggggccgctgtcgtcaggcctgagccagggtgagctggtgcctgccttgcattttccttctggtgctgtgaagaccataggctggcaggcagctgagatgaactgtctttaccactgatgaggggcctctgccggctgagggtagcaagcaggggttgtgagtcaggctgggggacttgtttgaaagaaagaggagtggaaaatggttccaggagggaagaggttctttgagacacagtaccctgggaggcataggagaagggtcgggccagcccagcccagggcctgagttagactatttcccacatgttctctgccttcagtggggagggggtgccaccagggctgtcggccaggattgccactcctgtttcagaggaagcaggccgagagacttgcaccttggccaagccacacaatcagtggggcagccagagctcagacctgagccattttgtcagtatccaggaccccccggattctccacgccctccccatctcccagtctccctgccccccatgccccagaccggcccaccagggactagccgctgtcgcacagcctctggggtgcttggtctctgcaaagtcaaaggcctgacagctctgtggcctgggaatccattttcctgcggcagagcagggcctggtgtggaaccagggagctgtgggaagccacagcagaaatggaagaaaaacaggtctcagcccagggtcctcgctcactccctcactccccactttgaagccatctctgttctgcaggtgagaggatttaaagtcagtcacaaaggcttgggaacaaaaggaattctcttccaagaatgcctctgtggtgctgtttggtctctagaaacagggtcacttttttaatgtagtaaagaagtaataaatggtggcattacacattgtgatattaaaaaaaaaaaa

SEQ ID NO: 302277 - DNA, 3177 bp, Homo sapiens
cgctgctctgcggggaggcgggcgctcccgcaggggttcctccaagatggcggcgcagaggaggagcttgctgcagagtgagcagcagccaagctggacagatgacctgcctctctgccacctctctggggttggctcagcctccaaccgcagctactctgctgatggcaagggcactgagagccacccgccagaggacagctggctcaagttcaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaccaaagcccgaccttaaccctgcagtccaccaacacgcacacgcagagcagcagctccagctctgacggaggcctcttccgctcccggcccgcccactcgctcccgcctggcgaggacggtcgtgttgagccctatgtggactttgctgagttttaccgcctctggagcgtggaccatggcgagcagagcgtggtgacagcaccgtagggcagccggagaatgcagcccaagcagggcctggcatggggcaggacagggtccagccttttcctaacatctgcctgtgccacaacggccagcaggtgccccatcctctgcccacagcagactctgtcccatggctctccgggcagtagagtgtgtgagtgcagactggacctgtggttcataccttgtcaccacccgggaagctgaaggccacttcctcccagatggcctcagccaggaccatcgccctttctcagagcagagggccaggtatagaaaccgcagtgggcctgcaagccgcccgagcctccccagcagcctcctacagagcaggaagaggcgccctgtgaaccctgagtgttgcaggcccagcagaccctgctgtcccaagcccacccctcctcccaccatcacctccctcacctcgggacagtagccctccacttctccagcctctcagccctgtgctcctgcatccagagtggaacccaggctggtgtccgcatctgtccctgggccccacccctggacctgccttggttgtgtcatctgttgtaaacattcaggaggaccagggcagcatctggggcctgggatggccacagaaggggcaggccaggtggaaaggagccagggggaagtggtctaagagacctggaactgccagaggatggcggcctgggcttccccagagccaggcgtgcgggagaggtgaggactggccccggtgggctgaggcaggggccgctgtcgtcaggcctgagccagggtgagctggtgcctgccttgcattttccttctggtgctgtgaagaccataggctggcaggcagctgagatgaactgtctttaccactgatgaggggcctctgccggctgagggtagcaagcaggggttgtgagtcaggctgggggacttgtttgaaagaaagaggagtggaagagaagggtcgggccagcccagcccagggcctgagttagactatttcccacatgttctctgccttcagtggggagggggtgccaccagggctgtcggccaggattgccactcctgtttcagaggaagcaggccgagagacttgcaccttggccaagccacacaatcagtggggcagccagagctcagacctgagccattttgtcagtatccaggaccccccggattctccacgccctccccatctcccagtctccctgccccccatgccccagaccggcccaccagggactagccgctgtcgcacagcctctggggtgcttggtctctgcaaagtcaaaggcctgacagctctgtggcctgggaatccattttcctgcggcagagcagggcctggtgtggaaccagggagctgtgggaagccacagcagaaatggaagaaaaacaggtctcagcccagggtcctcgctcactccctcactccccactttgaagccatctctgttctgcaggtgagaggatttaaagtcagtcacaaaggcttgggaacaaaaggaattctcttccaagaatgcctctgtggtgctgtttggtctctagaaacagggtcacttttttaatgtagtaaagaagtaataaatggtggcattacacattgtgatattaaaaaaaaaaaa

SEQ ID NO: 302278 - DNA, 3213 bp, Homo sapiens
  misc_feature (21)..(21): n is a, c, g, or t
ttgagataccctgcgcccccntgagttaatgggatcgcagaggaggagcttgctgcagagtgagcagcagccaagctggacagatgacctgcctctctgccacctctctggggttggctcagcctccaaccgcagctactctgctgatggcaagggcactgagagccacccgccagaggacagctggctcaagttcaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaccaaagcccgaccttaaccctgcagtccaccaacacgcacacgcagagcagcagctccagctctgacggaggcctcttccgctcccggcccgcccactcgctcccgcctggcgaggacggtcgtgttgagccctatgtggactttgctgagttttaccgcctctggagcgtggaccatggcgagcagagcgtggtgacagcaccgtagggcagccggagaatgcagcccaagcagggcctggcatggggcaggacagggtccagccttttcctaacatctgcctgtgccacaacggccagcaggtgccccatcctctgcccacagcagactctgtcccatggctctccgggcagtagagtgtgtgagtgcagactggacctgtggttcataccttgtcaccacccgggaagctgaaggccacttcctcccagatggcctcagccaggaccatcgccctttctcagagcagagggccaggtatagaaaccgcagtgggcctgcaagccgcccgagcctccccagcagcctcctacagagcaggaagaggcgccctgtgaaccctgagtgttgcaggcccagcagaccctgctgtcccaagcccacccctcctcccaccatcacctccctcacctcgggacagtagccctccacttctccagcctctcagccctgtgctcctgcatccagagtggaacccaggctggtgtccgcatctgtccctgggccccacccctggacctgccttggttgtgtcatctgttgtaaacattcaggaggaccagggcagcatctggggcctgggatggccacagaaggggcaggccaggtggaaaggagccagggggaagtggtctaagagacctggaactgccagaggatggcggcctgggcttccccagagccaggcgtgcgggagaggtgaggactggccccggtgggctgaggcaggggccgctgtcgtcaggcctgagccagggtgagctggtgcctgccttgcattttccttctggtgctgtgaagaccataggctggcaggcagctgagatgaactgtctttaccactgatgaggggcctctgccggctgagggtagcaagcaggggttgtgagtcaggctgggggacttgtttgaaagaaagaggagtggaaaatggttccaggagggaagaggttctttgagacacagtaccctgggaggcataggagaagggtcgggccagcccagcccagggcctgagttagactatttcccacatgttctctgccttcagtggggagggggtgccaccagggctgtcggccaggattgccactcctgtttcagaggaagcaggccgagagacttgcaccttggccaagccacacaatcagtggggcagccagagctcagacctgagccattttgtcagtatccaggaccccccggattctccacgccctccccatctcccagtctccctgccccccatgccccagaccggcccaccagggactagccgctgtcgcacagcctctggggtgcttggtctctgcaaagtcaaaggcctgacagctctgtggcctgggaatccattttcctgcggcagagcagggcctggtgtggaaccagggagctgtgggaagccacagcagaaatggaagaaaaacaggtctcagcccagggtcctcgctcactccctcactccccactttgaagccatctctgttctgcaggtgagaggatttaaagtcagtcacaaaggcttgggaacaaaaggaattctcttccaagaatgcctctgtggtgctgtttggtctctagaaacagggtcacttttttaatgtagtaaagaagtaataaatggtggcattacacattgtgatattaaaaaaaaaaaa

SEQ ID NO: 302279 - DNA, 2728 bp, Homo sapiens
gtgaaatgcctgccttttccctctctgccttcccggtatgccctatttctctctgtgtgtagtctttgcttagctgttcacattctgccacaggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaccaaagcccgaccttaaccctgcagtccaccaacacgcacacgcagagcagcagctccagctctgacggaggcctcttccgctcccggcccgcccactcgctcccgcctggcgaggacggtcgtgttgagccctatgtggactttgctgagttttaccgcctctggagcgtggaccatggcgagcagagcgtggtgacagcaccgtagggcagccggagaatgcagcccaagcagggcctggcatggggcaggacagggtccagccttttcctaacatctgcctgtgccacaacggccagcaggtgccccatcctctgcccacagcagactctgtcccatggctctccgggcagtagagtgtgtgagtgcagactggacctgtggttcataccttgtcaccacccgggaagctgaaggccacttcctcccagatggcctcagccaggaccatcgccctttctcagagcagagggccaggtatagaaaccgcagtgggcctgcaagccgcccgagcctccccagcagcctcctacagagcaggaagaggcgccctgtgaaccctgagtgttgcaggcccagcagaccctgctgtcccaagcccacccctcctcccaccatcacctccctcacctcgggacagtagccctccacttctccagcctctcagccctgtgctcctgcatccagagtggaacccaggctggtgtccgcatctgtccctgggccccacccctggacctgccttggttgtgtcatctgttgtaaacattcaggaggaccagggcagcatctggggcctgggatggccacagaaggggcaggccaggtggaaaggagccagggggaagtggtctaagagacctggaactgccagaggatggcggcctgggcttccccagagccaggcgtgcgggagaggtgaggactggccccggtgggctgaggcaggggccgctgtcgtcaggcctgagccagggtgagctggtgcctgccttgcattttccttctggtgctgtgaagaccataggctggcaggcagctgagatgaactgtctttaccactgatgaggggcctctgccggctgagggtagcaagcaggggttgtgagtcaggctgggggacttgtttgaaagaaagaggagtggaaaatggttccaggagggaagaggttctttgagacacagtaccctgggaggcataggagaagggtcgggccagcccagcccagggcctgagttagactatttcccacatgttctctgccttcagtggggagggggtgccaccagggctgtcggccaggattgccactcctgtttcagaggaagcaggccgagagacttgcaccttggccaagccacacaatcagtggggcagccagagctcagacctgagccattttgtcagtatccaggaccccccggattctccacgccctccccatctcccagtctccctgccccccatgccccagaccggcccaccagggactagccgctgtcgcacagcctctggggtgcttggtctctgcaaagtcaaaggcctgacagctctgtggcctgggaatccattttcctgcggcagagcagggcctggtgtggaaccagggagctgtgggaagccacagcagaaatggaagaaaaacaggtctcagcccagggtcctcgctcactccctcactccccactttgaagccatctctgttctgcaggtgagaggatttaaagtcagtcacaaaggcttgggaacaaaaggaattctcttccaagaatgcctctgtggtgctgtttggtctctagaaacagggtcacttttttaatgtagtaaagaagtaataaatggtggcattacacattgtgatattaaaaaaaaaaaa

SEQ ID NO: 302280 - DNA, 2231 bp, Homo sapiens
cgctgctctgcggggaggcgggcgctcccgcaggggttcctccaagatggcggcgcagaggaggagcttgctgcagagtgagcagcagccaagctggacagatgacctgcctctctgccacctctctggggttggctcagcctccaaccgcagctactctgctgatggcaagggcactgagagccacccgccagaggacagctggctcaagttcaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaccaaagcccgaccttaaccctgcagtccaccaacacgcacacgcagagcagcagctccagctctgacggaggcctcttccgctcccggcccgcccactcgctcccgcctggcgaggacggtcgtgttgagccctatgtggactttgctgagttttaccgcctctggagcgtggaccatggcgagcagagcgtggtgacagcaccgtagggcagccggagaatgcagcccaagcagggcctggcatggggcaggacagggtccagccttttcctaacatctgcctgtgccacaacggccagcaggtgccccatcctctgcccacagcagactctgtcccatggctctccgggcagtagagtgtgtgagtgcagactggacctgtggttcataccttgtcaccacccgggaagctgaaggccacttcctcccagatggcctcagccaggaccatcgccctttctcagagcagagggccaggtatagaaaccgcagtgggcctgcaagccgcccgagcctccccagcagcctcctacagagcaggaagaggcgccctgtgaaccctgggaatccattttcctgcggcagagcagggcctggtgtggaaccagggagctgtgggaagccacagcagaaatggaagaaaaacaggtctcagcccagggtcctcgctcactccctcactccccactttgaagccatctctgttctgcaggtgagaggatttaaagtcagtcacaaaggcttgggaacaaaaggaattctcttccaagaatgcctctgtggtgctgtttggtctctagaaacagggtcacttttttaatgtagtaaagaagtaataaatggtggcattacacattgtgatattaaaaaaaaaaaa

SEQ ID NO: 302281 - DNA, 1440 bp, Homo sapiens
cgctgctctgcggggaggcgggcgctcccgcaggggttcctccaagatggcggcgcagaggaggagcttgctgcagagtgagcagcagccaagctggacagatgacctgcctctctgccacctctctggggttggctcagcctccaaccgcagctactctgctgatggcaagggcactgagagccacccgccagaggacagctggctcaagttcaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgtgggcagcgctaacaggcagttccactgtgggaagccacagcagaaatggaagaaaaacaggtctcagcccagggtcctcgctcactccctcactccccactttgaagccatctctgttctgcaggtgagaggatttaaagtcagtcacaaaggcttgggaacaaaaggaattctcttccaagaatgcctctgtggtgctgtttggtctctagaaacagggtcacttttttaatgtagtaaagaagtaataaatggtggcattacacattgtgatattaaaaaaaaaaaa

SEQ ID NO: 302282 - DNA, 540 bp, Homo sapiens
atctcggctcactgtaacctccacctcccgggttcaagtcattcttctgcctcagcctcctgagtagctgggactacaggcatgtgccaccaccacacccggctaatttttgtatttttagtagagatggggttttgcctttttggccaggcttatcttgaactcgtaacctcagatgatccacctgccttggcctcccaaagttctgggattatagacatgagccactgcgcccagcctgtgttctgatttctttacctgttatataagcttaccattccttccagtagccttataacatagagggacaggggcttatttccaggtagagtagggaatttggggtccacggagttcaggttcttgccagaagtgacgttgctgcttagtgttgaaactgagcccaccaggaccaggtgcaggtcatttcctattacctgtccctgccctcctgccccgcccaaaagaaactttatgatggtgagaaagtgatacatattcagtgggaactgtgctcccatacccctacaaccattctgt

SEQ ID NO: 302283 - DNA, 376 bp, Homo sapiens
ggagagagcagtgaggccggagagaaagaagctgccgcggaggaagacaggctgcgggttcccgggactgcaggtccaggcagggtaggagccgcacctcgttccttaccaggttcttcctaccccctcccccaggagattgctgcgatgattgacactgagtttgccaagcagacctccctggacgcagtggcccaggccgtcgtggaccgggtgaagcgcatccacagcgacaccttcacacacccaggctggagagacactgcgctcagggacggcttgatggtagccaggacctcctctctactgcgggggtgggcgggggcggaggatgggaactggctagtgagcactgaaatataaattctaaatcctc

SEQ ID NO: 302284 - DNA, 3353 bp, Homo sapiens
cgctgctctgcggggaggcgggcgctcccgcaggggttcctccaagatggcggcgcagaggaggagcttgctgcagagtgagcagcagccaagctggacagatgacctgcctctctgccacctctctggggttggctcagcctccaaccgcagctactctgctgatggcaagggcactgagagccacccgccagaggacagctggctcaagttcaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccagatggagtcttgctctgttggccaagctggagtgcagtggtgcaatctcggctcactgtaacctccacctcccgggttcaagtcattcttctgcctcagcctcctgagtagctgggactacaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaccaaagcccgaccttaaccctgcagtccaccaacacgcacacgcagagcagcagctccagctctgacggaggcctcttccgctcccggcccgcccactcgctcccgcctggcgaggacggtcgtgttgagccctatgtggactttgctgagttttaccgcctctggagcgtggaccatggcgagcagagcgtggtgacagcaccgtagggcagccggagaatgcagcccaagcagggcctggcatggggcaggacagggtccagccttttcctaacatctgcctgtgccacaacggccagcaggtgccccatcctctgcccacagcagactctgtcccatggctctccgggcagtagagtgtgtgagtgcagactggacctgtggttcataccttgtcaccacccgggaagctgaaggccacttcctcccagatggcctcagccaggaccatcgccctttctcagagcagagggccaggtatagaaaccgcagtgggcctgcaagccgcccgagcctccccagcagcctcctacagagcaggaagaggcgccctgtgaaccctgagtgttgcaggcccagcagaccctgctgtcccaagcccacccctcctcccaccatcacctccctcacctcgggacagtagccctccacttctccagcctctcagccctgtgctcctgcatccagagtggaacccaggctggtgtccgcatctgtccctgggccccacccctggacctgccttggttgtgtcatctgttgtaaacattcaggaggaccagggcagcatctggggcctgggatggccacagaaggggcaggccaggtggaaaggagccagggggaagtggtctaagagacctggaactgccagaggatggcggcctgggcttccccagagccaggcgtgcgggagaggtgaggactggccccggtgggctgaggcaggggccgctgtcgtcaggcctgagccagggtgagctggtgcctgccttgcattttccttctggtgctgtgaagaccataggctggcaggcagctgagatgaactgtctttaccactgatgaggggcctctgccggctgagggtagcaagcaggggttgtgagtcaggctgggggacttgtttgaaagaaagaggagtggaaaatggttccaggagggaagaggttctttgagacacagtaccctgggaggcataggagaagggtcgggccagcccagcccagggcctgagttagactatttcccacatgttctctgccttcagtggggagggggtgccaccagggctgtcggccaggattgccactcctgtttcagaggaagcaggccgagagacttgcaccttggccaagccacacaatcagtggggcagccagagctcagacctgagccattttgtcagtatccaggaccccccggattctccacgccctccccatctcccagtctccctgccccccatgccccagaccggcccaccagggactagccgctgtcgcacagcctctggggtgcttggtctctgcaaagtcaaaggcctgacagctctgtggcctgggaatccattttcctgcggcagagcagggcctggtgtggaaccagggagctgtgggaagccacagcagaaatggaagaaaaacaggtctcagcccagggtcctcgctcactccctcactccccactttgaagccatctctgttctgcaggtgagaggatttaaagtcagtcacaaaggcttgggaacaaaaggaattctcttccaagaatgcctctgtggtgctgtttggtctctagaaacagggtcacttttttaatgtagtaaagaagtaataaatggtggcattacacattgtgatattaaaaaaaaaaaa

SEQ ID NO: 302285 - DNA, 2923 bp, Homo sapiens
attttggcaccagtgacagtggtgttttgaaccagcctttgccctgtcctgtgtccccctaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaccaaagcccgaccttaaccctgcagtccaccaacacgcacacgcagagcagcagctccagctctgacggaggcctcttccgctcccggcccgcccactcgctcccgcctggcgaggacggtcgtgttgagccctatgtggactttgctgagttttaccgcctctggagcgtggaccatggcgagcagagcgtggtgacagcaccgtagggcagccggagaatgcagcccaagcagggcctggcatggggcaggacagggtccagccttttcctaacatctgcctgtgccacaacggccagcaggtgccccatcctctgcccacagcagactctgtcccatggctctccgggcagtagagtgtgtgagtgcagactggacctgtggttcataccttgtcaccacccgggaagctgaaggccacttcctcccagatggcctcagccaggaccatcgccctttctcagagcagagggccaggtatagaaaccgcagtgggcctgcaagccgcccgagcctccccagcagcctcctacagagcaggaagaggcgccctgtgaaccctgagtgttgcaggcccagcagaccctgctgtcccaagcccacccctcctcccaccatcacctccctcacctcgggacagtagccctccacttctccagcctctcagccctgtgctcctgcatccagagtggaacccaggctggtgtccgcatctgtccctgggccccacccctggacctgccttggttgtgtcatctgttgtaaacattcaggaggaccagggcagcatctggggcctgggatggccacagaaggggcaggccaggtggaaaggagccagggggaagtggtctaagagacctggaactgccagaggatggcggcctgggcttccccagagccaggcgtgcgggagaggtgaggactggccccggtgggctgaggcaggggccgctgtcgtcaggcctgagccagggtgagctggtgcctgccttgcattttccttctggtgctgtgaagaccataggctggcaggcagctgagatgaactgtctttaccactgatgaggggcctctgccggctgagggtagcaagcaggggttgtgagtcaggctgggggacttgtttgaaagaaagaggagtggaaaatggttccaggagggaagaggttctttgagacacagtaccctgggaggcataggagaagggtcgggccagcccagcccagggcctgagttagactatttcccacatgttctctgccttcagtggggagggggtgccaccagggctgtcggccaggattgccactcctgtttcagaggaagcaggccgagagacttgcaccttggccaagccacacaatcagtggggcagccagagctcagacctgagccattttgtcagtatccaggaccccccggattctccacgccctccccatctcccagtctccctgccccccatgccccagaccggcccaccagggactagccgctgtcgcacagcctctggggtgcttggtctctgcaaagtcaaaggcctgacagctctgtggcctgggaatccattttcctgcggcagagcagggcctggtgtggaaccagggagctgtgggaagccacagcagaaatggaagaaaaacaggtctcagcccagggtcctcgctcactccctcactccccactttgaagccatctctgttctgcaggtgagaggatttaaagtcagtcacaaaggcttgggaacaaaaggaattctcttccaagaatgcctctgtggtgctgtttggtctctagaaacagggtcacttttttaatgtagtaaagaagtaataaatggtggcattacacattgtgatattaaaaaaaaaaaa

SEQ ID NO: 302286 - DNA, 2963 bp, Homo sapiens
cgctgctctgcggggaggcgggcgctcccgcaggggttcctccaagatggcggcgcagaggaggagcttgctgcagagtgagcagcagccaagctggacagatgacctgcctctctgccacctctctggggttggctcagcctccaaccgcagctactctgctgatggcaagggcactgagagccacccgccagaggacagctggctcaagttcaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaccaaagcccgaccttaaccctgcagtccaccaacacgcacacgcagagcagcagctccagctctgacggaggcctcttccgctcccggcccgcccactcgctcccgcctggcgaggacggtcgtgttgagccctatgtggactttgctgagttttaccgcctctggagcgtggaccatggcgagcagagcgtggtgacagcaccgtagggcagccggagaatgcagcccaagcagggcctggcatggggcaggacagggtccagccttttcctaacatctgcctgtgccacaacggccagcaggtgccccatcctctgcccacagcagactctgtcccatggctctccgggcagtagagtgtgtgagtgcagactggacctgtggttcataccttgtcaccacccgggaagctgaaggccacttcctcccagatggcctcagccaggaccatcgccctttctcagagcagagggccaggtatagaaaccgcagtgggcctgcaagccgcccgagcctccccagcagcctcctacagagcaggaagaggcgccctgtgaaccctgagtgttgcaggcccagcagaccctgctgtcccaagcccacccctcctcccaccatcacctccctcacctcgggacagtagccctccacttctccagcctctcagccctgtgctcctgcatccagagtggaacccaggctggtgtccgcatctgtccctgggccccacccctggacctgccttggttgtgtcatctgttgtaaacattcaggaggaccagggcagcatctggggcctgggatggccacagaaggggcaggccaggtggaaaggagccagggggaagtggtctaagagacctggaactgccagaggatggcggcctgggcttccccagagccaggcgtgcgggagaggtgaggactggccccggtgggctgaggcaggggccgctgtcgtcaggcctgagccagggtgagctggtgcctgccttgcattttccttctggtgctgtgaagaccataggctggcaggcagctgagatgaactgtctttaccactgatgaggggcctctgccggctgagggtagcaagcaggggttgtgagtcaggctgggggacttgtttgaaagaaagaggagtggaaaatggttccaggagggaagaggttctttgagacacagtaccctgggaggcataggagaagggtcgggccagcccagcccagggcctgagttagactatttcccacatgttctctgcaaagtcaaaggcctgacagctctgtggcctgggaatccattttcctgcggcagagcagggcctggtgtggaaccagggagctgtgggaagccacagcagaaatggaagaaaaacaggtctcagcccagggtcctcgctcactccctcactccccactttgaagccatctctgttctgcaggtgagaggatttaaagtcagtcacaaaggcttgggaacaaaaggaattctcttccaagaatgcctctgtggtgctgtttggtctctagaaacagggtcacttttttaatgtagtaaagaagtaataaatggtggcattacacattgtgatattaaaaaaaaaaaa

SEQ ID NO: 302287 - DNA, 620 bp, Homo sapiens
  misc_feature (35)..(37): n is a, c, g, or t
  misc_feature (39)..(39): n is a, c, g, or t
  misc_feature (41)..(41): n is a, c, g, or t
aacgccaccgcccccgccacgcagatggggaaaannnanancctgagatggactgttacatgagtcagacatggaagtcaatgattgaacttaacaagcacctcccactagaagaagtctggggacctgagtttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactattaca

SEQ ID NO: 302288 - DNA, 855 bp, Homo sapiens
gtttcaacctgtggttcaactatttgatgataatggctatgttaaagacgttgaagcaaatttcatagtgtgggaaatacacggcagggatgactatagctttaataatactatggcacagagtggttgtttacatgaagcacagacatggaagtcaatgattgaacttaacaagcacctcccactagaagaagtctggggacctgagaactataaacactgtttttcttatgctattggaaaaccaggagacttaaatcaaccatacgagattatcaacagttctaatggtaaccatatattttggcccatgggccattctggaatgtatgtatttcgtgtgaagatcctggatccaaactatagtttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactattaca

SEQ ID NO: 302289 - DNA, 554 bp, Homo sapiens
aataacaatcaagaaatatcgataaaaaaactccagcgacccggccataaattaacccttcgatttttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactattaca

SEQ ID NO: 302290 - DNA, 494 bp, Homo sapiens
gaaggtgactgatgtgatcctacagctgctgtagatagtacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactattaca

SEQ ID NO: 302291 - DNA, 752 bp, Homo sapiens
  misc_feature (35)..(37): n is a, c, g, or t
  misc_feature (39)..(39): n is a, c, g, or t
  misc_feature (41)..(41): n is a, c, g, or t
aacgccaccgcccccgccacgcagatggggaaaannnanancctgagatggactgttacatgagtcagacatggaagtcaatgattgaacttaacaagcacctcccactagaagaagtctggggacctgagtttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactattacaatcctttgtaagaatgaaagtgaatttttgaaaatatatctatgtgtcaagtatcattttgcatgaaacttttcacatgaaaccttatatgactgtagttaatttatatataaaggatttaataaaggtgtg

SEQ ID NO: 302292 - DNA, 700 bp, Homo sapiens
  misc_feature (35)..(37): n is a, c, g, or t
  misc_feature (39)..(39): n is a, c, g, or t
  misc_feature (41)..(41): n is a, c, g, or t
aacgccaccgcccccgccacgcagatggggaaaannnanancctgagatggactgttacatgagtcagacatggaagtcaatgattgaacttaacaagcacctcccactagaagaagtctggggacctgagagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactattacaatcctttgtaagaatgaaagtgaatttttgaaaatatatctatgtgtcaagtatcattttgcatgaaacttttcacatgaaaccttatatgactgtagttaatttatatataaaggatttaataaaggtgtg

SEQ ID NO: 302293 - DNA, 437 bp, Homo sapiens
aataacaatcaagaaatatcgataaaaaaactccagcgacccggccataaattaacccttcgatttttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaactgcaggcaatcaagaatggaagatcacaagcaagatgaaattccacgggcactgatcaaagctgctgtccacaaagaattgctcatgtcaccaaaatcaagaataggacagagatacctgctggtcatcgctgttttgaaagttctgacgtcacaggagaaaaataaaataaacagta

SEQ ID NO: 302294 - DNA, 473 bp, Homo sapiens
  misc_feature (35)..(37): n is a, c, g, or t
  misc_feature (39)..(39): n is a, c, g, or t
  misc_feature (41)..(41): n is a, c, g, or t
aacgccaccgcccccgccacgcagatggggaaaannnanancctgagatggactgttacatgagtcagacatggaagtcaatgattgaacttaacaagcacctcccactagaagaagtctggggacctgagtttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgattaaacaagtctgaaatccacagtgcaggcaatcaagaatggaagatcacaagcaagatgaaattccacgggcactgatcaaaaattgctcatgtcaccaaaatcaagaataggacagagatacctgctggtcatcgctgttttgaaagttctgacgtcacaggagaaaaataaaataaacagta

SEQ ID NO: 302295 - DNA, 2830 bp, Homo sapiens
  misc_feature (28)..(29): n is a, c, g, or t
acattgggctcctcctcctcgggcccanntccgagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacaggtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgaggtcgcagggtgctccactgaggactgcccgccccagccagaggtgtctgttacctccaccatgccaaatgtggcccctgctgctatacatgccgccccaggggacactgtctctggaaagccaggcacacccaagggtgcaggaatggcaggcccaggcggtttggcacgcagcagccggaacgagtacatgcgctcgggcctctattccaccttcaccatccagtctctgcagccgcagccaccccctcatcctcggcctgctgtggtgctccccagtgcagctcctgcaggggcagcagcgcccccctcggggagcaggagcaccagtccaagccccttggaggcctgtctggaggctgaagaggccggcttgcctctgcaggtcatcctgaccccgcccgaggccccaaacctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccaggatcgggaagtggctccggcctccaggctccggggccggcgctgaccccatccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagttccctccctcccagccccccaatttcctgcgggcgggtacaaaggaccctttcaatgtccctggagttgggagggaggaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggaccttttttttttctaaagagtcccagagaatggggaattgttcctgtaaatatatatttttcaaagtga

SEQ ID NO: 302296 - DNA, 2936 bp, Homo sapiens
  misc_feature (28)..(29): n is a, c, g, or t
acattgggctcctcctcctcgggcccanntccgagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacagcctcaactttcaggagacccgtccgtggccttatttattccacccttcctgtacatcgtagcgaatcaatccgtggcgccgcactcctccgcatccctctttaacagtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgaggtcgcagggtgctccactgaggactgcccgccccagccagaggtgtctgttacctccaccatgccaaatgtggcccctgctgctatacatgccgccccaggggacactgtctctggaaagccaggcacacccaagggtgcaggaatggcaggcccaggcggtttggcacgcagcagccggaacgagtacatgcgctcgggcctctattccaccttcaccatccagtctctgcagccgcagccaccccctcatcctcggcctgctgtggtgctccccagtgcagctcctgcaggggcagcagcgcccccctcggggagcaggagcaccagtccaagccccttggaggcctgtctggaggctgaagaggccggcttgcctctgcaggtcatcctgaccccgcccgaggccccaaacctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccaggatcgggaagtggctccggcctccaggctccggggccggcgctgaccccatccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagttccctccctcccagccccccaatttcctgcgggcgggtacaaaggaccctttcaatgtccctggagttgggagggaggaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggaccttttttttttctaaagagtcccagagaatggggaattgttcctgtaaatatatatttttcaaagtga

SEQ ID NO: 302297 - DNA, 2791 bp, Homo sapiens
  misc_feature (1)..(1): n is a, c, g, or t
ngtctagaggttcccctcaggggcgagctgccaacgccaccgccagctacacacagcctcaactttcaggagacccgtccgtggccttatttattccacccttcctgtacatcgtagcgaatcaatccgtggcgccgcactcctccgcatccctctttaacagtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgaggtcgcagggtgctccactgaggactgcccgccccagccagaggtgtctgttacctccaccatgccaaatgtggcccctgctgctatacatgccgccccaggggacactgtctctggaaagccaggcacacccaagggtgcaggaatggcaggcccaggcggtttggcacgcagcagccggaacgagtacatgcgctcgggcctctattccaccttcaccatccagtctctgcagccgcagccaccccctcatcctcggcctgctgtggtgctccccagtgcagctcctgcaggggcagcagcgcccccctcggggagcaggagcaccagtccaagccccttggaggcctgtctggaggctgaagaggccggcttgcctctgcaggtcatcctgaccccgcccgaggccccaaacctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccaggatcgggaagtggctccggcctccaggctccggggccggcgctgaccccatccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagttccctccctcccagccccccaatttcctgcgggcgggtacaaaggaccctttcaatgtccctggagttgggagggaggaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggaccttttttttttctaaagagtcccagagaatggggaattgttcctgtaaatatatatttttcaaagtga

SEQ ID NO: 302298 - DNA, 3519 bp, Homo sapiens
  misc_feature (28)..(29): n is a, c, g, or t
acattgggctcctcctcctcgggcccanntccgagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacagcctcaactttcaggagacccgtccgtggccttatttattccacccttcctgtacatcgtagcgaatcaatccgtggcgccgcactcctccgcatccctctttaacagtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgaggtcgcagggtgctccactgaggactgcccgccccagccagaggtgtctgttacctccaccatgccaaatgtggcccctgctgctatacatgccgccccaggggacactgtctctggaaagccaggcacacccaagggtgcaggaatggcaggcccaggcggtttggcacgcagcagccggaacgagtacatgcgctcgggcctctattccaccttcaccatccagtctctgcagccgcagccaccccctcatcctcggcctgctgtggtgctccccagtgcagctcctgcaggggcagcagcgcccccctcggggagcaggagcaccagtccaagccccttggaggcctgtctggaggctgaagaggccggcttgcctctgcaggtcatcctgaccccgcccgaggccccaaacctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccaggatcgggaagtggctccggcctccaggctccggggccggcgctgaccccatccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagttccctccctcccagccccccaatttcctgcgggcgggtacaaaggaccctttcaatgtccctggagttgggagggaggaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggaccttttttttttctaaagagtcccagagaatggggaattgttcctgtaaatatatatttttcaaagtgatcaaaagctgaacaaaacaaaaaaaacaaacaaaaaagaaaacaaaaaacaaaagaggtgcggcgcgcgccacgcccagagaagggtatctccccctacggagtgtgtgcgcccacaaagtgtataaagcgggcggttaccccccagcgagctcttcggttggccgcccaagagtgggtgcccccctatatatgaggagagcggcagggataattatataataagcgcgctatagaggcggtcagtgaggcagccgagtcgatttatatatcaacaaagcggtttgcttcgtagtagagtgtgtgaggagaaaaacctgtgtcgtcaaaccgcgaggttggcgaagaacacctccgtgtggtgtgaaacacgaagtgatcacccctctatgatcgcctctgcccggtgaggtaggggtgatgcggccaacccatatacgtgtgggggccacaaaaaaacttctatccgcctcccgaggacggaagaagattatttatacaagaagacgcgcgtacttaaaggaggggattaaagaattgtcttatacaagaaatcttgtaacgaagggtggtggttaatcata

SEQ ID NO: 302299 - DNA, 2058 bp, Homo sapiens
  misc_feature (28)..(29): n is a, c, g, or t
acattgggctcctcctcctcgggcccanntccgagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacagcctcaactttcaggagacccgtccgtggccttatttattccacccttcctgtacatcgtagcgaatcaatccgtggcgccgcactcctccgcatccctctttaacagtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagttccctccctcccagccccccaatttcctgcgggcgggtacaaaggaccctttcaatgtccctggagttgggagggaggaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggaccttttttttttctaaagagtcccagagaatggggaattgttcctgtaaatatatatttttcaaagtga

SEQ ID NO: 302300 - DNA, 2857 bp, Homo sapiens
  misc_feature (28)..(29): n is a, c, g, or t
acattgggctcctcctcctcgggcccanntccgagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacagcctcaactttcaggagacccgtccgtggccttatttattccacccttcctgtacatcgtagcgaatcaatccgtggcgccgcactcctccgcatccctctttaacagtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgaggtcgcagggtgctccactgaggactgcccgccccagccagaggtgtctgttacctccaccatgccaaatgtggcccctgctgctatacatgccgccccaggggacactgtctctggaaagccaggcacacccaagggtgcaggaatggcaggcccaggcggtttggcacgcagcagccggaacgagtacatgcgctcgggcctctattccaccttcaccatccagtctctgcagccgcagccaccccctcatcctcggcctgctgtggtgctccccagtgcagctcctgcaggggcagcagcgcccccctcggggagcaggagcaccagtccaagccccttggaggcctgtctggaggctgaagaggccggcttgcctctgcaggtcatcctgaccccgcccgaggccccaaacctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccaggatcgggaagtggctccggcctccaggctccggggccggcgctgaccccatccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggaccttttttttttctaaagagtcccagagaatggggaattgttcctgtaaatatatatttttcaaagtga

SEQ ID NO: 302301 - DNA, 1529 bp, Homo sapiens
  misc_feature (28)..(29): n is a, c, g, or t
acattgggctcctcctcctcgggcccanntccgagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacaggtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgaggtcgcagggtgctccactgaggactgcccgccccagccagaggtgtctgttacctccaccatgccaaatgtggcccctgctgctatacatgccgccccaggggacactgtctctggaaagccaggcacacccaagggtgcaggaatggcaggcccaggcggtttggcacgcagcagccggaacgagtacatgcgctcgggcctctattccaccttcaccatccagtctctgcagccgcagccaccccctcatcctcggcctgctgtggtgctccccagtgcagctcctgcaggggcagcagcgcccccctcggggagcaggagcaccagtccaagccccttggaggcctgtctggaggctgaagaggccggcttgcctctgcaggtcatcctgaccccgcccgaggccccaaacctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctagacaagacaatcgaggtctggcttgagaacgacctttctttctttatttctcagcctgcccttggggagatgagggagccctgtctgcgtttttggatgttccctccctcccagccccccaatttcctaaagagtcccagagaatggggaattgttcctgtaaatatatatttttcaaagtgaaaaaaaaaaaagaaaaacctgccataatgaagagcagaccaatattccagaaaactgtcactttaacagagaagaccaaattctagtttcacatgaactgttaatattaaagctaattttaattaaa

SEQ ID NO: 302302 - DNA, 4101 bp, Homo sapiens
ttccgggccccagagcgcttataatggagccgctgtcagcagaaccttctgccgccgccgccgccgccgccgtccctcctcttttttttcccggcagatctttgttgtgtgggagggcagcagggatggacttgagcttgcggatcccctgctagagcagccgcgctcggagaaggcgccgcagccgcgaggaggagccgccgccgccgcgcccgaggccccgccgcccgcggcctctgtcggcccgcgccccgctcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgatagcttatagtgatttaggatactacattatcaataaactgcaccatgtggacgagtcggtggggagcaagacgagaagggccttcctgtacctcgccgcctttcctttcatggacgcaatggcatggacccatgctggcattctcttaaaacacaaatacagtttcctggtgggatgtgcctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggacacccaacgtgtctgagaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtccttgcccccagctctgtgctgcggatcatcgtcctcatcgccagcctcgtggtcctaccctacctgggggtgcacggtgcgaccctgggcgtgggctccctcctggcgggctttgtgggagaatccaccatggtcgccatcgctgcgtgctatgtctaccggaagcagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgctcacactgacggggggacctagtgaatggtctttactgttgctatgtaaaaacaaacgaaacaactgacttcatacccctgcctcacgaaaacccaaaagacacagctgcctcacggttgacgttgtgtcctcctcccctggacaatctcctcttggaaccaaaggactgcagctgtgccatcgcgcctcggtcaccctgcacagcaggccacagactctcctgtcccccttcatcgctcttaagaatcaacaggttaaaactcggcttcctttgatttgcttcccagtcacatggccgtacaaagagatggagccccggtggcctcttaaatttcccttccgccacggagttcgaaaccatctactccacacatgcaggaggcgggtggcacgctgcagcccggagtccccgttcacactgaggaacggagacctgtgaccacagcaggctgacagatggacagaatctcccgtagaaaggtttggtttgaaatgccccgggggcagcaaactgacatggttgaatgatagcatttcactctgcgttctcctagatctgagcaagctgtcagttctcacccccaccgtgtatatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccagcattctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaacaaaaaaatattttaaagatataaatatatgctgtatatgttatgtaatttattttaggctataatacatttcctattttcgcattttcaataaaatgtctctaatacaatacggtgattgcttgtgtgctcaacatacctgcagttgaaacgtattgtatcaatgaacattgtaccttattggcagcagttttataaagtccgtcatttgcatttgaatgtaaggctcagtaaatgacagaactatttttcattatgggtaactggggaataaatgggtcactggagtaggaatagaagtgcaagctggaaaggcaaaaatgagaaagaaaaaggcaggccctttgtgtctaccgttttcagtgctgtgtgatcatattgttcctcacagcaaaaaagaatgcaagggcataatgttagctgtgaacatgccagggttgcattcacattcctgggtacccagtgctgatggggtgtgcccacgtggggacatgtccttggcgtgcttcctcagagtggcttttcctccattaatacatatatgagtactgaaaaattaagttgcatagctgctttgcagtggtttcagaggcagatctgagaagattaaaaaaaaatctcaaatgtatcagctttttttaaaggacattactagaaaattaaacagtattttttaacatgtgtgactttcatgcttctggggttggagcttaaagatccaaactgagaaagcaggccgggcatggtggctcatgcctgtaatcccaacactttgggaggccaaggagggtggatcacttaaggtcaggagtttgagaccagcctggccaacatggcgaaaccctgtctctactaaaaacataaaaattagctgggggtggtagcacatacctgtaatcccagctactcaggaggctgaggcaggagaatttgcttgatcctgggaggcagaggttgtagtgagccgagatcgcgccatcgcactccagcctgggtgacaagagcaaaactccatctc

SEQ ID NO: 302303 - DNA, 2635 bp, Homo sapiens
ttccgggccccagagcgcttataatggagccgctgtcagcagaaccttctgccgccgccgccgccgccgccgtccctcctcttttttttcccggcagatctttgttgtgtgggagggcagcagggatggacttgagcttgcggatcccctgctagagcagccgcgctcggagaaggcgccgcagccgcgaggaggagccgccgccgccgcgcccgaggccccgccgcccgcggcctctgtcggcccgcgccccgctcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgatagcttatagtgatttaggatactacattatcaataaactgcaccatgtggacgagtcggtggggagcaagacgagaagggccttcctgtacctcgccgcctttcctttcatggacgcaatggcatggacccatgctggcattctcttaaaacacaaatacagtttcctggtgggatgtgcctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggacacccaacgtgtctgagaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtccttgcccccagctctgtgctgcggatcatcgtcctcatcgccagcctcgtggtcctaccctacctgggggtgcacggtgcgaccctgggcgtgggctccctcctggcgggctttgtgggagaatccaccatggtcgccatcgctgcgtgctatgtctaccggaagcagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgcccttcctgatctaacattctgtttatgatctaggatttagaacgtcgtatgagatcctacaatggaagaataaaatcacctcattcttcatttcagatctgaacattagcagtgatctagatttttttttttttaaacaaaattaagtgtgcttagagtcattcctctacatgggctgtggctgtcagcccataggtttgtcagtttcacatcaaaactgtgggtataaactgttgaaaccaatcacattaaaatatttagctgggcacagtggtgtgcatctgtagtcccagctacttgggaggctgaggcaggaggatcgcttaagcacaggagttggaatccagcctgagcaacagagcaaaaccccgtctctaaaatacaaataaaatatttgtgtagtttttgattaaaattgactacagcggtcagtataaaatacatgtcgcttttaaggaagtgctctttatgtatctaacagatggaagtttttgcattggtaagagcatttatatatgctttgtttcagggtttatggatttgtattcatatattgtcaaataggtttcatactctaattttactttaagtaaagcttaaacacttggcatacaactgagattgcttttagtttcttgatttttttttattcta

SEQ ID NO: 302304 - DNA, 681 bp, Homo sapiens
cacgcgtcggtgctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacggcattgagcccctgcgggatcccaggcccatctgtctgctgaggatacagctgtgagcaagcgtgtgtgacactgtgtcagcagcaaagcctgtctgtatttctatgcgcaaccttaaataaacaacacgcatccttcgttatgaagcc

SEQ ID NO: 302305 - DNA, 570 bp, Homo sapiens
aggacatggtccctgcgctcagggagctcccagcgtcctggggagggtgggaagggctgtgggatccatgtgctgtgggagggaggtggcccagccccgagttcctggttcccctcacacattaggttattagctgcggcccttacgaagccagcagatggagaacgccgctggtctcagccgtctcgaggctacacttactttcctgggttttggcatcgacggttgtgccttgacttggccttaacagacaaattgcctttgtgttctcatctgcagggtgcacggtgcgaccctgggcgtgggctccctcctggcgggctttgtgggagaatccaccatggtcgccatcgctgcgtgctatgtctaccggaagcaggtgagacagccgcgccgggagcctcctcccgggtgcatcctcctgggtgcaggagaacctgagcagccactgaccaggttggatggtggcgttcgtcagtgggggatccttggtgacactgcccagtctcgtggcttagggtggctggaagcctaatgggagtggggtaagaaaaaaggggaaaagctgaa

SEQ ID NO: 302306 - DNA, 318 bp, Homo sapiens
gacccatgaattaccgaatttcgagcctcggtaacccctgtatcccggggaccaagacgagaagggccttcctgtacctcgccgcctttcctttcatggacgcaatggtgagtagagaagatcgttggctttctttctttttctttaactggtggtaaaatatacataatataaaatctaccattttagctatttttgtgtgtacagcttaatggcaggaagtacattcacattattgtgtaaccaatcttcagaactcttcatcttgcaaaactgagattctatcctaattcaacagtaaccctcctcggccccctc

SEQ ID NO: 302307 - DNA, 4047 bp, Homo sapiens
ttccgggccccagagcgcttataatggagccgctgtcagcagaaccttctgccgccgccgccgccgccgccgtccctcctcttttttttcccggcagatctttgttgtgtgggagggcagcagggatggacttgagcttgcggatcccctgctagagcagccgcgctcggagaaggcgccgcagccgcgaggaggagccgccgccgccgcgcccgaggccccgccgcccgcggcctctgtcggcccgcgccccgctcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgatagcttatagtgatttaggatactacattatcaataaactgcaccatgtggacgagtcggtggggagcaagacgagaagggccttcctgtacctcgccgcctttcctttcatggacgcaatggcatggacccatgctggcattctcttaaaacacaaatacagtttcctggtgggatgtgcctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggacacccaacgtgtctgagaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtccttgcccccagctctgtgctgcggatcatcgtcctcatcgccagcctcgtggtcctaccctacctgggggtgcacggtgcgaccctgggcgtgggctccctcctggcgggctttgtgggagaatccaccatggtcgccatcgctgcgtgctatgtctaccggaagcagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgctcacactgacggggggacctagtgaatggtctttactgttgctatgtaaaaacaaacgaaacaactgacttcatacccctgcctcacgaaaacccaaaagacacagctgcctcacggttgacgttgtgtcctcctcccctggacaatctcctcttggaaccaaaggactgcagctgtgccatcgcgcctcggtcaccctgcacagcaggccacagactctcctgtcccccttcatcgctcttaagaatcaacaggttaaaactcggcttcctttgatttgcttcccagtcacatggccgtacaaagagatggagccccggtggcctcttaaatttcccttccgccacggagttcgaaaccatctactccacacatgcaggaggcgggtggcacgctgcagcccggagtccccgttcacactgaggaacggagacctgtgaccacagcaggctgacagatggacagaatctcccgtagaaaggtttggtttgaaatgccccgggggcagcaaactgacatggttgaatgatagcatttcactctgcgttctcctagatctgagcaagctgtcagttctcacccccaccgtgtatatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccagcattctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaacaaaaaaatattttaaagatataaatatatgctgtatatgttatgtaatttattttaggctataatacatttcctattttcgcattttcaattgaaacgtattgtatcaatgaacattgtaccttattggcagcagttttataaagtccgtcatttgcatttgaatgtaaggctcagtaaatgacagaactatttttcattatgggtaactggggaataaatgggtcactggagtaggaatagaagtgcaagctggaaaggcaaaaatgagaaagaaaaaggcaggccctttgtgtctaccgttttcagtgctgtgtgatcatattgttcctcacagcaaaaaagaatgcaagggcataatgttagctgtgaacatgccagggttgcattcacattcctgggtacccagtgctgatggggtgtgcccacgtggggacatgtccttggcgtgcttcctcagagtggcttttcctccattaatacatatatgagtactgaaaaattaagttgcatagctgctttgcagtggtttcagaggcagatctgagaagattaaaaaaaaatctcaaatgtatcagctttttttaaaggacattactagaaaattaaacagtattttttaacatgtgtgactttcatgcttctggggttggagcttaaagatccaaactgagaaagcaggccgggcatggtggctcatgcctgtaatcccaacactttgggaggccaaggagggtggatcacttaaggtcaggagtttgagaccagcctggccaacatggcgaaaccctgtctctactaaaaacataaaaattagctgggggtggtagcacatacctgtaatcccagctactcaggaggctgaggcaggagaatttgcttgatcctgggaggcagaggttgtagtgagccgagatcgcgccatcgcactccagcctgggtgacaagagcaaaactccatctc

SEQ ID NO: 302308 - DNA, 3816 bp, Homo sapiens
acaatgacgttgagaataggcgactgattctctgtgtggccagaattagagcctaaggccaccagaagctcagcatcttgcttattgttgcatctccccccagcccctgggcatcaccaacatagccatcgacttcggggagcaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgatagcttatagtgatttaggatactacattatcaataaactgcaccatgtggacgagtcggtggggagcaagacgagaagggccttcctgtacctcgccgcctttcctttcatggacgcaatggcatggacccatgctggcattctcttaaaacacaaatacagtttcctggtgggatgtgcctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggacacccaacgtgtctgagaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtccttgcccccagctctgtgctgcggatcatcgtcctcatcgccagcctcgtggtcctaccctacctgggggtgcacggtgcgaccctgggcgtgggctccctcctggcgggctttgtgggagaatccaccatggtcgccatcgctgcgtgctatgtctaccggaagcagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgctcacactgacggggggacctagtgaatggtctttactgttgctatgtaaaaacaaacgaaacaactgacttcatacccctgcctcacgaaaacccaaaagacacagctgcctcacggttgacgttgtgtcctcctcccctggacaatctcctcttggaaccaaaggactgcagctgtgccatcgcgcctcggtcaccctgcacagcaggccacagactctcctgtcccccttcatcgctcttaagaatcaacaggttaaaactcggcttcctttgatttgcttcccagtcacatggccgtacaaagagatggagccccggtggcctcttaaatttcccttccgccacggagttcgaaaccatctactccacacatgcaggaggcgggtggcacgctgcagcccggagtccccgttcacactgaggaacggagacctgtgaccacagcaggctgacagatggacagaatctcccgtagaaaggtttggtttgaaatgccccgggggcagcaaactgacatggttgaatgatagcatttcactctgcgttctcctagatctgagcaagctgtcagttctcacccccaccgtgtatatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccagcattctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaacaaaaaaatattttaaagatataaatatatgctgtatatgttatgtaatttattttaggctataatacatttcctattttcgcattttcaataaaatgtctctaatacaatacggtgattgcttgtgtgctcaacatacctgcagttgaaacgtattgtatcaatgaacattgtaccttattggcagcagttttataaagtccgtcatttgcatttgaatgtaaggctcagtaaatgacagaactatttttcattatgggtaactggggaataaatgggtcactggagtaggaatagaagtgcaagctggaaaggcaaaaatgagaaagaaaaaggcaggccctttgtgtctaccgttttcagtgctgtgtgatcatattgttcctcacagcaaaaaagaatgcaagggcataatgttagctgtgaacatgccagggttgcattcacattcctgggtacccagtgctgatggggtgtgcccacgtggggacatgtccttggcgtgcttcctcagagtggcttttcctccattaatacatatatgagtactgaaaaattaagttgcatagctgctttgcagtggtttcagaggcagatctgagaagattaaaaaaaaatctcaaatgtatcagctttttttaaaggacattactagaaaattaaacagtattttttaacatgtgtgactttcatgcttctggggttggagcttaaagatccaaactgagaaagcaggccgggcatggtggctcatgcctgtaatcccaacactttgggaggccaaggagggtggatcacttaaggtcaggagtttgagaccagcctggccaacatggcgaaaccctgtctctactaaaaacataaaaattagctgggggtggtagcacatacctgtaatcccagctactcaggaggctgaggcaggagaatttgcttgatcctgggaggcagaggttgtagtgagccgagatcgcgccatcgcactccagcctgggtgacaagagcaaaactccatctc

SEQ ID NO: 302309 - DNA, 3773 bp, Homo sapiens
gttctgctggcatttcgtcgggatgaagacaacacagccaggaaatccagaggttggccttgataacttagagttctaacaagggcagcactgatagtcctggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgatagcttatagtgatttaggatactacattatcaataaactgcaccatgtggacgagtcggtggggagcaagacgagaagggccttcctgtacctcgccgcctttcctttcatggacgcaatggcatggacccatgctggcattctcttaaaacacaaatacagtttcctggtgggatgtgcctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggacacccaacgtgtctgagaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtccttgcccccagctctgtgctgcggatcatcgtcctcatcgccagcctcgtggtcctaccctacctgggggtgcacggtgcgaccctgggcgtgggctccctcctggcgggctttgtgggagaatccaccatggtcgccatcgctgcgtgctatgtctaccggaagcagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgctcacactgacggggggacctagtgaatggtctttactgttgctatgtaaaaacaaacgaaacaactgacttcatacccctgcctcacgaaaacccaaaagacacagctgcctcacggttgacgttgtgtcctcctcccctggacaatctcctcttggaaccaaaggactgcagctgtgccatcgcgcctcggtcaccctgcacagcaggccacagactctcctgtcccccttcatcgctcttaagaatcaacaggttaaaactcggcttcctttgatttgcttcccagtcacatggccgtacaaagagatggagccccggtggcctcttaaatttcccttccgccacggagttcgaaaccatctactccacacatgcaggaggcgggtggcacgctgcagcccggagtccccgttcacactgaggaacggagacctgtgaccacagcaggctgacagatggacagaatctcccgtagaaaggtttggtttgaaatgccccgggggcagcaaactgacatggttgaatgatagcatttcactctgcgttctcctagatctgagcaagctgtcagttctcacccccaccgtgtatatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccagcattctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaacaaaaaaatattttaaagatataaatatatgctgtatatgttatgtaatttattttaggctataatacatttcctattttcgcattttcaataaaatgtctctaatacaatacggtgattgcttgtgtgctcaacatacctgcagttgaaacgtattgtatcaatgaacattgtaccttattggcagcagttttataaagtccgtcatttgcatttgaatgtaaggctcagtaaatgacagaactatttttcattatgggtaactggggaataaatgggtcactggagtaggaatagaagtgcaagctggaaaggcaaaaatgagaaagaaaaaggcaggccctttgtgtctaccgttttcagtgctgtgtgatcatattgttcctcacagcaaaaaagaatgcaagggcataatgttagctgtgaacatgccagggttgcattcacattcctgggtacccagtgctgatggggtgtgcccacgtggggacatgtccttggcgtgcttcctcagagtggcttttcctccattaatacatatatgagtactgaaaaattaagttgcatagctgctttgcagtggtttcagaggcagatctgagaagattaaaaaaaaatctcaaatgtatcagctttttttaaaggacattactagaaaattaaacagtattttttaacatgtgtgactttcatgcttctggggttggagcttaaagatccaaactgagaaagcaggccgggcatggtggctcatgcctgtaatcccaacactttgggaggccaaggagggtggatcacttaaggtcaggagtttgagaccagcctggccaacatggcgaaaccctgtctctactaaaaacataaaaattagctgggggtggtagcacatacctgtaatcccagctactcaggaggctgaggcaggagaatttgcttgatcctgggaggcagaggttgtagtgagccgagatcgcgccatcgcactccagcctgggtgacaagagcaaaactccatctc

SEQ ID NO: 302310 - DNA, 3288 bp, Homo sapiens
cacgcgtcggtgctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggacacccaacgtgtctgagaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtccttgcccccagctctgtgctgcggatcatcgtcctcatcgccagcctcgtggtcctaccctacctgggggtgcacggtgcgaccctgggcgtgggctccctcctggcgggctttgtgggagaatccaccatggtcgccatcgctgcgtgctatgtctaccggaagcagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgctcacactgacggggggacctagtgaatggtctttactgttgctatgtaaaaacaaacgaaacaactgacttcatacccctgcctcacgaaaacccaaaagacacagctgcctcacggttgacgttgtgtcctcctcccctggacaatctcctcttggaaccaaaggactgcagctgtgccatcgcgcctcggtcaccctgcacagcaggccacagactctcctgtcccccttcatcgctcttaagaatcaacaggttaaaactcggcttcctttgatttgcttcccagtcacatggccgtacaaagagatggagccccggtggcctcttaaatttcccttccgccacggagttcgaaaccatctactccacacatgcaggaggcgggtggcacgctgcagcccggagtccccgttcacactgaggaacggagacctgtgaccacagcaggctgacagatggacagaatctcccgtagaaaggtttggtttgaaatgccccgggggcagcaaactgacatggttgaatgatagcatttcactctgcgttctcctagatctgagcaagctgtcagttctcacccccaccgtgtatatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccagcattctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaacaaaaaaatattttaaagatataaatatatgctgtatatgttatgtaatttattttaggctataatacatttcctattttcgcattttcaataaaatgtctctaatacaatacggtgattgcttgtgtgctcaacatacctgcagttgaaacgtattgtatcaatgaacattgtaccttattggcagcagttttataaagtccgtcatttgcatttgaatgtaaggctcagtaaatgacagaactatttttcattatgggtaactggggaataaatgggtcactggagtaggaatagaagtgcaagctggaaaggcaaaaatgagaaagaaaaaggcaggccctttgtgtctaccgttttcagtgctgtgtgatcatattgttcctcacagcaaaaaagaatgcaagggcataatgttagctgtgaacatgccagggttgcattcacattcctgggtacccagtgctgatggggtgtgcccacgtggggacatgtccttggcgtgcttcctcagagtggcttttcctccattaatacatatatgagtactgaaaaattaagttgcatagctgctttgcagtggtttcagaggcagatctgagaagattaaaaaaaaatctcaaatgtatcagctttttttaaaggacattactagaaaattaaacagtattttttaacatgtgtgactttcatgcttctggggttggagcttaaagatccaaactgagaaagcaggccgggcatggtggctcatgcctgtaatcccaacactttgggaggccaaggagggtggatcacttaaggtcaggagtttgagaccagcctggccaacatggcgaaaccctgtctctactaaaaacataaaaattagctgggggtggtagcacatacctgtaatcccagctactcaggaggctgaggcaggagaatttgcttgatcctgggaggcagaggttgtagtgagccgagatcgcgccatcgcactccagcctgggtgacaagagcaaaactccatctc

SEQ ID NO: 302311 - DNA, 2441 bp, Homo sapiens
ttacgaattcagccccgggaccccgtcgaccggaagcagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgctcacactgacggggggacctagtgaatggtctttactgttgctatgtaaaaacaaacgaaacaactgacttcatacccctgcctcacgaaaacccaaaagacacagctgcctcacggttgacgttgtgtcctcctcccctggacaatctcctcttggaaccaaaggactgcagctgtgccatcgcgcctcggtcaccctgcacagcaggccacagactctcctgtcccccttcatcgctcttaagaatcaacaggttaaaactcggcttcctttgatttgcttcccagtcacatggccgtacaaagagatggagccccggtggcctcttaaatttcccttccgccacggagttcgaaaccatctactccacacatgcaggaggcgggtggcacgctgcagcccggagtccccgttcacactgaggaacggagacctgtgaccacagcaggctgacagatggacagaatctcccgtagaaaggtttggtttgaaatgccccgggggcagcaaactgacatggttgaatgatagcatttcactctgcgttctcctagatctgagcaagctgtcagttctcacccccaccgtgtatatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccagcattctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaacaaaaaaatattttaaagatataaatatatgctgtatatgttatgtaatttattttaggctataatacatttcctattttcgcattttcaataaaatgtctctaatacaatacggtgattgcttgtgtgctcaacatacctgcagttgaaacgtattgtatcaatgaacattgtaccttattggcagcagttttataaagtccgtcatttgcatttgaatgtaaggctcagtaaatgacagaactatttttcattatgggtaactggggaataaatgggtcactggagtaggaatagaagtgcaagctggaaaggcaaaaatgagaaagaaaaaggcaggccctttgtgtctaccgttttcagtgctgtgtgatcatattgttcctcacagcaaaaaagaatgcaagggcataatgttagctgtgaacatgccagggttgcattcacattcctgggtacccagtgctgatggggtgtgcccacgtggggacatgtccttggcgtgcttcctcagagtggcttttcctccattaatacatatatgagtactgaaaaattaagttgcatagctgctttgcagtggtttcagaggcagatctgagaagattaaaaaaaaatctcaaatgtatcagctttttttaaaggacattactagaaaattaaacagtattttttaacatgtgtgactttcatgcttctggggttggagcttaaagatccaaactgagaaagcaggccgggcatggtggctcatgcctgtaatcccaacactttgggaggccaaggagggtggatcacttaaggtcaggagtttgagaccagcctggccaacatggcgaaaccctgtctctactaaaaacataaaaattagctgggggtggtagcacatacctgtaatcccagctactcaggaggctgaggcaggagaatttgcttgatcctgggaggcagaggttgtagtgagccgagatcgcgccatcgcactccagcctgggtgacaagagcaaaactccatctc

SEQ ID NO: 302312 - DNA, 2535 bp, Homo sapiens
caccccaaccataagaaggtttaagcctacagtgaggggtcccccaagaccccggtgttgtctccctgctcgtggttctgctgtgcagtgtccccatccacagccccacactgatgagtcttctttggtctagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgctcacactgacggggggacctagtgaatggtctttactgttgctatgtaaaaacaaacgaaacaactgacttcatacccctgcctcacgaaaacccaaaagacacagctgcctcacggttgacgttgtgtcctcctcccctggacaatctcctcttggaaccaaaggactgcagctgtgccatcgcgcctcggtcaccctgcacagcaggccacagactctcctgtcccccttcatcgctcttaagaatcaacaggttaaaactcggcttcctttgatttgcttcccagtcacatggccgtacaaagagatggagccccggtggcctcttaaatttcccttccgccacggagttcgaaaccatctactccacacatgcaggaggcgggtggcacgctgcagcccggagtccccgttcacactgaggaacggagacctgtgaccacagcaggctgacagatggacagaatctcccgtagaaaggtttggtttgaaatgccccgggggcagcaaactgacatggttgaatgatagcatttcactctgcgttctcctagatctgagcaagctgtcagttctcacccccaccgtgtatatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccagcattctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaacaaaaaaatattttaaagatataaatatatgctgtatatgttatgtaatttattttaggctataatacatttcctattttcgcattttcaataaaatgtctctaatacaatacggtgattgcttgtgtgctcaacatacctgcagttgaaacgtattgtatcaatgaacattgtaccttattggcagcagttttataaagtccgtcatttgcatttgaatgtaaggctcagtaaatgacagaactatttttcattatgggtaactggggaataaatgggtcactggagtaggaatagaagtgcaagctggaaaggcaaaaatgagaaagaaaaaggcaggccctttgtgtctaccgttttcagtgctgtgtgatcatattgttcctcacagcaaaaaagaatgcaagggcataatgttagctgtgaacatgccagggttgcattcacattcctgggtacccagtgctgatggggtgtgcccacgtggggacatgtccttggcgtgcttcctcagagtggcttttcctccattaatacatatatgagtactgaaaaattaagttgcatagctgctttgcagtggtttcagaggcagatctgagaagattaaaaaaaaatctcaaatgtatcagctttttttaaaggacattactagaaaattaaacagtattttttaacatgtgtgactttcatgcttctggggttggagcttaaagatccaaactgagaaagcaggccgggcatggtggctcatgcctgtaatcccaacactttgggaggccaaggagggtggatcacttaaggtcaggagtttgagaccagcctggccaacatggcgaaaccctgtctctactaaaaacataaaaattagctgggggtggtagcacatacctgtaatcccagctactcaggaggctgaggcaggagaatttgcttgatcctgggaggcagaggttgtagtgagccgagatcgcgccatcgcactccagcctgggtgacaagagcaaaactccatctc

SEQ ID NO: 302313 - DNA, 2637 bp, Homo sapiens
ttccgggccccagagcgcttataatggagccgctgtcagcagaaccttctgccgccgccgccgccgccgccgtccctcctcttttttttcccggcagatctttgttgtgtgggagggcagcagggatggacttgagcttgcggatcccctgctagagcagccgcgctcggagaaggcgccgcagccgcgaggaggagccgccgccgccgcgcccgaggccccgccgcccgcggcctctgtcggcccgcgccccgctcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgatagcttatagtgatttaggatactacattatcaataaactgcaccatgtggacgagtcggtggggagcaagacgagaagggccttcctgtacctcgccgcctttcctttcatggacgcaatggcatggacccatgctggcattctcttaaaacacaaatacagtttcctggtgggatgtgcctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggacacccaacgtgtctgagaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtccttgcccccagctctgtgctgcggatcatcgtcctcatcgccagcctcgtggtcctaccctacctgggggtgcacggtgcgaccctgggcgtgggctccctcctggcgggctttgtgggagaatccaccatggtcgccatcgctgcgtgctatgtctaccggaagcagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgcccttcctgatctaacattctgtttatgatctaggatttagaacgtcgtatgagatcctacaatggaagaataaaatcacctcattcttcatttcagatctgaacattagcagtgatctagatttttttttttttaaacaaaattaagtgtgcttagagtcattcctctacatgggctgtggctgtcagcccataggtttgtcagtttcacatcaaaactgtgggtataaactgttgaaaccaatcacattaaaatatttagctgggcacagtggtgtgcatctgtagtcccagctacttgggaggctgaggcaggaggatcgcttaagcacaggagttggaatccagcctgagcaacagagcaaaaccccgtctctaaaatacaaataaaatatttgtgtagtttttgattaaaattgactacagcggtcagtataaaatacatgtcgcttttaaggaagtgctctttatgtatctaacagatggaagtttttgcattggtaagagcatttatatatgctttgtttcagggtttatggatttgtattcatatattgtcaaataggtttcatactctaattttactttaagtaaagcttaaacgtcgacgcggccgggaatttactagtatttgtcgacccgggaatttcggaccgg

SEQ ID NO: 302314 - DNA, 1841 bp, Homo sapiens
ttccgggccccagagcgcttataatggagccgctgtcagcagaaccttctgccgccgccgccgccgccgccgtccctcctcttttttttcccggcagatctttgttgtgtgggagggcagcagggatggacttgagcttgcggatcccctgctagagcagccgcgctcggagaaggcgccgcagccgcgaggaggagccgccgccgccgcgcccgaggccccgccgcccgcggcctctgtcggcccgcgccccgctcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgatagcttatagtgatttaggatactacattatcaataaactgcaccatgtggacgagtcggtggggagcaagacgagaagggccttcctgtacctcgccgcctttcctttcatggacgcaatggcatggacccatgctggcattctcttaaaacacaaatacagtttcctggtgggatgtgcctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggacacccaacgtgtctgagaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtccttgcccccagctctgtgctgcggatcatcgtcctcatcgccagcctcgtggtcctaccctacctgggggtgcacggtgcgaccctgggcgtgggctccctcctggcgggctttgtgggagaatccaccatggtcgccatcgctgcgtgctatgtctaccggaagcagaaaaagatgatggataatgatttgtccacgggaggggaaaactttgcttgacaaacatgctttctacagaggatgtgacacacattcttggaatgagagagggaatttttttgtgtcggtactccttgggcctttcatggac

SEQ ID NO: 302315 - DNA, 1842 bp, Homo sapiens
ttccgggccccagagcgcttataatggagccgctgtcagcagaaccttctgccgccgccgccgccgccgccgtccctcctcttttttttcccggcagatctttgttgtgtgggagggcagcagggatggacttgagcttgcggatcccctgctagagcagccgcgctcggagaaggcgccgcagccgcgaggaggagccgccgccgccgcgcccgaggccccgccgcccgcggcctctgtcggcccgcgccccgctcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgataggtgaggccgccgaccgccactgacgaatctagctttggcaatttcttattccttttcattgatttaaatgtatttattgagataagtggtttcttcactaattatcaaatgtttcttatgaaattttcaggggatagaaggaaagcgcttgtgctcctagcttaagacaataatgtgttttttctggggagctgtagttttgtgtctctgattcccaaagtgaaaagcagtgatttcattagtaggcgattacatctaggaataacatttggtaaggccaataaaatagcaggtgctttcgttagagatatgtgtgcgtcattgtactgggtcattaaatcttaagaataaaaatagaatgacttatttagaattaatgcttattagcagtgagaacaaatgacagattgttctatttattaatttgttctaggatcttattctattttattcaaagacaagactaaatgctcttgtgatagcattctttccatgaaacaacaggaaagctgtatcatacatacagtgactggcctccagtttaaccaagaccctggaaaagcagctctccttcagggctggagttctgctgctgctttcttggtggggataaagccttcagggcatgacttccgtcgtggctttaaaacagctttgcttacctggcataaaaattgagtggtacctctactgaaaccagttacataaaacactgtgaatgacacttcataaacccattgtgtaccttaaaattgttactgattgtttaagacgcgtgactgtcagtggtgaataaaggaaccaaaagattaacccagaccgtttacagtgtgtttgcatggcagctaatgcttactcacataactgcgaatctgaaagtaaataaggtaaggcctttgtggttttcctttttaatgtgacataaaattttgtgctaagaacattgtggaagagagcgcatctgctgatggaccagacattcagccaaagcgttgatattgatcctttaatttgtgctcagagcttcagggcatggagtaaagaggagctgcctctcatttcctcagtttatgccctgaaggctaactgtggactgagtatttgcacatgtacttgtatttgaagtaaatttctgctacatttgacctgagccattttcaaagaatacatgtacagtatttgggaaaaaaaaaag

SEQ ID NO: 302316 - DNA, 1494 bp, Homo sapiens
ttccgggccccagagcgcttataatggagccgctgtcagcagaaccttctgccgccgccgccgccgccgccgtccctcctcttttttttcccggcagatctttgttgtgtgggagggcagcagggatggacttgagcttgcggatcccctgctagagcagccgcgctcggagaaggcgccgcagccgcgaggaggagccgccgccgccgcgcccgaggccccgccgcccgcggcctctgtcggcccgcgccccgctcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgatagcttatagtgatttaggatactacattatcaataaactgcaccatgtggacgagtcggtggggagcaagacgagaagggccttcctgtacctcgccgcctttcctttcatggacgcaatggcatggacccatgctggcattctcttaaaacacaaatacagtttcctggtgggatgtgcctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacggcattgagcccctgcgggatcccaggcccatctgtctgctgaggatacagctgtgagcaagcgtgtgtgacactgtgtcagcagcaaagcctgtctgtatttctatgcgcaaccttaaataaacaacacgcatccttcgttatgaagcc

SEQ ID NO: 302317 - DNA, 1715 bp, Homo sapiens
ttccgggccccagagcgcttataatggagccgctgtcagcagaaccttctgccgccgccgccgccgccgccgtccctcctcttttttttcccggcagatctttgttgtgtgggagggcagcagggatggacttgagcttgcggatcccctgctagagcagccgcgctcggagaaggcgccgcagccgcgaggaggagccgccgccgccgcgcccgaggccccgccgcccgcggcctctgtcggcccgcgccccgctcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgatagcttatagtgatttaggatactacattatcaataaactgcaccatgtggacgagtcggtggggagcaagacgagaagggccttcctgtacctcgccgcctttcctttcatggacgcaatggcatggacccatgctggcattctcttaaaacacaaatacagtttcctggtgggatgtgcctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacggtaaggacagaggctctctctgcctcttctctctgtttggtttttgtaaaggggcaagttgctattttaaagggggaaatcttattttccacaatgtaatgtgatgctggattaattagcaatctcttcaatacactttcttcttcaaatgtgaacgattgttattcaaggaggcccttgagtctaggaataaaggacccacttcaggcatttcttgggacttctcaaatgctgcagaaaggaagaggttgcctttaattggaatagtacacttgtcttgctgaaaaatttctagcccactttttaaacatcgaaagtcaactttacaaccacccctgtctcttttccaaatttaatccgcgttacttca

SEQ ID NO: 302318 - DNA, 977 bp, Homo sapiens
ttccgggccccagagcgcttataatggagccgctgtcagcagaaccttctgccgccgccgccgccgccgccgtccctcctcttttttttcccggcagatctttgttgtgtgggagggcagcagggatggacttgagcttgcggatcccctgctagagcagccgcgctcggagaaggcgccgcagccgcgaggaggagccgccgccgccgcgcccgaggccccgccgcccgcggcctctgtcggcccgcgccccgctcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgatagcttatagtgatttaggatactacattatcaataaactgcaccatgtggacgagtcggtggggagcaagacgagaagggccttcctgtacctcgccgcctttcctttcatggacgcaatggtgagtagagaagatcgttggctttctttctttttctttaactggtggtaaaatatacataatataaaatctaccattttagctatttttgtgtgtacagcttaatggcaggaagtacattcacattattgtgtaaccaatcttcagaactcttcatcttgcaaaactgagattctatcctaattcaacagtaaccctcctcggccccctc

SEQ ID NO: 302319 - DNA, 1312 bp, Homo sapiens
tggccatgtgaaatattttattttccaggctaaagcaaatgaaagtttgctggtatcaacacagcctgccatatttttcacagcatgcaacaatggtgctaggatagctatttcttactgtaattgccagaggcagaaatggtctgggtataagctatttcataaaagcagctttaaattgtcagtattaaggttttcatgtggaaaggtgtcattcaaaaaaaaagtaattggcatacatattccacatcatcgatcctctctgtggtgttaatttttttatatgaccagtagaaaaattttaatattctcacaatataggttttggggcttccatatcatcaaaagactgaaaaattataattttagaattaaactgatggatttcattatagaattatctgtgagttgtgtagacacagtcttaatgtttctggttatgacagataagtttgctcaaaaaatgtggatgaagccattattgttattattgttattgcttctgttcagttgtctaagtatcatcccttctgtggcccatcacgcagcagagttgccctacaaatttcatttggcagcgccataacattcatttaaaaagtttatgaaaacattcatttgaaagttccatgcagctttagcacagagttgaccaaacactggcgtaagttcaatttacacagaatatttgaattgaaacaatagaaatttttctcataatatatacctatgtgaaaccaacttatctgcataattaaatctaatacatatttaagccagtttaagtgctttgtgttgatgccatgcttatcaaatacatgcacaagctaaacataatttgaatgggtctatgaaggaaaaataatgcttagactttggtgtaggttcttcctgtgtagccatatacccaggctctgcagtatcgaaggatgcaaatgttgacatagatggaagctcttacctaccaaagtgtttaggaaggataaagttacatttgtcttaatttctaacattatctttgcttttatgtttcataaaaatttgtcattatttatgctggtgaaacgtataatcacatccaattatttgaacacatgcaaaataattttttaaattatgttattgtttaaatttgacttatgggagatcagtcaaaaacttagaaggtttaacacttcactgattaatggtgctgaaaacacgttacaattaccacatatccttgctataagttttgaagtttcttagcaattaaagtttttttattcagtgtgaactgtcagtatctattctggtgctaaatgtatggtgc

SEQ ID NO: 302320 - DNA, 1119 bp, Homo sapiens
ctctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgaggtgagtgacctgcaggaagaaggcaagaatgccatcaactcaccgatgtcccccgccctggcggatgttcaccctgaagacacccagctcgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggtggtggtctgccttttccagtccacagattcagatgttaatctcctttggcaacaccctcacagacacacccaggaaccacgccttgcacccttcaatccaatcaagctgacagtattaaccatcacgcctgtggagaggggaagtggctcagatcctgcggggcttgaattgagaagatgcagccagcgtgtcccccctaggctttctttactagaccttaagctgtgctgggaacattcacaggccttctctgttttttgtttgtttgtttgtttgtttttaaggagaattccagctcttttaaattgtctctattattaaaaaacaaatgcaggaagagaaag

SEQ ID NO: 302321 - DNA, 1721 bp, Homo sapiens
ctctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgaggtgagtgacctgcaggaagaaggcaagaatgccatcaactcaccgatgtcccccgccctggcggatgttcaccctgaagacacccagctcgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtctctcatcacttttgtgaacaagcacctgaacaagctgaatttggaggtgacggaactggagacccagtttgcagatggcgtgtacctggttctgctcatgggccttctggaagactactttgttcctctccaccacttctacctgactccggaaagcttcgatcagaaggtccacaatgtgtccttcgcctttgagctgatgctggacggaggcctcaagaaacccaaggctcgtcctgaagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaaagtccca

SEQ ID NO: 302322 - DNA, 1644 bp, Homo sapiens
ccgaacggccccaagtcctcaagggacctggtgtctctatcatgtcaccaagcccaactgtttccctagctgtaaagagtaatatcccctgcctacaatcccagcacttcgggaggctgaggtgggcggatcacttgaagtcaggagttcaagaccagcttggccaacatggcaaaaccccatctctactaaaaaatacaaaaattagctgggcgtgatggtgtacgcctgtggtcctcagcctcccaaggagcgaggaccacaggtgtgtaccactacaccccgctaatttcacttttacaatgttctacagcagacagagctaatctgtggtggttgcctctggggctgtgggcaggagttacttggggaggagcaggagggattttctgttgttatgaaaatattctttacagtgagagtggtttgagatacgcaggtgcagcatttgtcaaaactctgcatgtgtactttaaatttgtgcatttcatggcatgtaccttttaactccaaggaaataaaagaactataaataaatactgaactctaattagtgatgtgtgtgattagagggaaaagtactgatgtctgcaacttactttgaaatgtgttaaaaaaagatgatatggtagactgaatagtagtaccaaaaatgtctatattccaatacctggaaactgagaatatgttctcttatgtggtcaaagggaatttgcaggtgtgattaagttaagaaccttgagatggaattagcctgggttatttgggtgggcccagcgtgattaccagggtccttatgagaaggaggcaggagggtcagagtcagagagaagtgacgatggaggtggaagttgcaatgatgtggggccaggagccaaggaatgtgagcagcctctgaaagctgcaaaagccaggaaattgatttcctcctggagcttctagagggaatgcagccctgctgacaccttgattttagccagtgagacccattttggagtcctggcatccggaaccacaagatagaaatttgtgtcgtatggaggccgggcgcggtggctcacgcctgtaatcccagcactttgggaggccgaggtggacggatcatgaggtcaggagatcgagaccacggtgaaaccccgtctctactaaaaatacaaaaaattagccgggcgtggtggcaggcgcctgtagtcccagctactcgagaggctgaggcaggagaatggtgtgaacccggaaggcagagcttgcagtgagccgagatcacgccactgcactccagcctgggcgacagagcaagactctgtctcaaaaaataaaaaaaaaaagaaagaaatttgtgtcgtatgaagtcccacagtttgtgggaattatttccagctgcaattggaaatgaatgctgatggattgctggatagatagagggatggacggatgtggaataaaacaagtatagacaaaggtgggtggtggactgtaggctgtgggtatacaagtgttcacttcaaactttacttggctgggagtgggggcccatgcctgtaatctcagcactttgggaggccgaggcgggtggatcacttgaggtcaggagttcgagaccagtcttgccaacatggtgaaactccatctctacaaaaatac

SEQ ID NO: 302323 - DNA, 1241 bp, Homo sapiens
ctctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgaggatgagatctcactctgatgcccaggctgaagtgcagtggtgcagtcatagctcactgcagcctcgaactcctggcctccagtgatccttctgcctcagcctcccaaggagcgaggaccacagtgagtgacctgcaggaagaaggcaagaatgccatcaactcaccgatgtcccccgccctggcggatgttcaccctgaagacacccagctcgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggtggtggtctgccttttccagtccacagattcagatgttaatctcctttggcaacaccctcacagacacacccaggaaccacgccttgcacccttcaatccaatcaagctgacagtattaaccatcacgcctgtggagaggggaagtggctcagatcctgcggggcttgaattgagaagatgcagccagcgtgtcccccctaggctttctttactagaccttaagctgtgctgggaacattcacaggccttctctgttttttgtttgtttgtttgtttgtttttaaggagaattccagctcttttaaattgtctctattattaaaaaacaaatgcaggaagagaaag

SEQ ID NO: 302324 - DNA, 701 bp, Homo sapiens
ctctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgaggtgagtgacctgcaggaagaaggcaagaatgccatcaactcaccgatgtcccccgccctggcggatgttcaccctgaagacacccagctcgaggagaacgaggagcgcacgatgattgaccccacttccaaggaagaccccaagttcaaggaactggtcaaggtaaggagctccgtcttggttggaatcttcctcttagggcgaggacttggctttggggttcagggctctcatggacaaagggagctaaacccggggctcctgaaagggatgttggtgctgcatgagaaggtgggcagacatgttggcagaggaggacggcagagaggatccagcccgaagtgccaagcgcctcccatgtgccctgctcggctggggctttaacgaccagtcttgtgaactctttgctggacagagctcggcaggaggggattttaggattaggaatgagtgctggcgtgagctagtgtagtaccttacagatggagttggaactccgtctggagcctggtggggtctagattc

SEQ ID NO: 302325 - DNA, 1896 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (250)..(250): n is a, c, g, or t
gnggncncntgcaaaggccctacactttgacgtcctccccatctccggcagctccttaaactaagaactcattttaatttctgaattctccctttttaaagaccagataaatttacctttgggacagttagatgtgcacaaatgcaccatgtgtttaaagatcaccaaagaggagagaaaaggggattccttagtccagagaacaaaaactgcaggaggctggagctgagacgtgggtgttcctgcagcnggggcctgtgctcccaggcactcatggcttctctggctggttcacttctccctggctcagacagatcaggagtggaaacatctgaatatgctcaaggaggagtgagtgacctgcaggaagaaggcaagaatgccatcaactcaccgatgtcccccgccctggcggatgttcaccctgaagacacccagctcgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtctctcatcacttttgtgaacaagcacctgaacaagctgaatttggaggtgacggaactggagacccagtttgcagatggcgtgtacctggttctgctcatgggccttctggaagactactttgttcctctccaccacttctacctgactccggaaagcttcgatcagaaggtccacaatgtgtccttcgcctttgagctgatgctggacggaggcctcaagaaacccaaggctcgtcctgaagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaaagtccca

SEQ ID NO: 302326 - DNA, 1996 bp, Homo sapiens
ctctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgaggtgagtgacctgcaggaagaaggcaagaatgccatcaactcaccgatgtcccccgccctggcggatgttcaccctgaagacacccagctcgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtctctcatcacttttgtgaacaagcacctgaacaagctgaatttggaggtgacggaactggagacccagtttgcagatggcgtgtacctggttctgctcatgggccttctggaagactactttgttcctctccaccacttctacctgactccggaaagcttcgatcagaaggtccacaatgtgtccttcgcctttgagctgatgctggacggaggcctcaagaaacccaaggctcgtcctgaaggactaaagcacagggtcatcccatggctgcttttggatcacagggagtcaggactccaagggcctcgagcgttacctggtccaggcccattttacagatgaaggcactgagccccaaatcacggaagtcacttagaggtcacagagcaagtgaaatgaacaaggtgtctgattcccaggaaggttcttgtccacataaagaaagtggcccaagacttccagggccccagagggagctgtcgggtccattaagtgttactggggtttttggtcccgacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaaagtccca

SEQ ID NO: 302327 - DNA, 1428 bp, Homo sapiens
ctctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgaggtgagtgacctgcaggaagaaggcaagaatgccatcaactcaccgatgtcccccgccctggcggatgttcaccctgaagacacccagctcgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtctctcatcacttttgtgaacaagcacctgaacaagctgaatttggaggtgacggaactggagacccagtttgcagatggcgtgtacctggttctgctcatgggccttctggaagactactttgttcctctccaccacttctacctgactccggaaagcttcgatcagaaggtccacaatgtgtccttcgcctttgagctgatgctggacggaggcctcaagaaacccaaggctcgtcctgaagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctcctaattgataaatcaaagttggcacatcatcttttctagaagttggaacttcctggcgggagggccaagttcccaaaatgggctttagggataaacggcacaatgccaacgtctttaatttgtcaccgcc

SEQ ID NO: 302328 - DNA, 1112 bp, Homo sapiens
ctctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgaggtgagtgacctgcaggaagaaggcaagaatgccatcaactcaccgatgtcccccgccctggcggatgttcaccctgaagacacccagctcgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtctctcatcacttttgtgaacaagcacctgaacaagctgaatttggaggtgacggaactggagacccagtttgcagatggcgtgtacctggttctgctcatgggccttctggaagactactttgttcctctccaccacttctacctgactccggaaagcttcgatcagaagtttgcagatggcgtgtacctggttctgctcatgggccttctggaagactactttgttcctctccaccacttctacctgagtccagaaagcttcgatcagaag

SEQ ID NO: 302329 - DNA, 1114 bp, Homo sapiens
tgcggcaggtgggtggctggatgtaatctggttcattgccggcatccctctgagtggtctttaaacacagcccagaaggcttttattttaaacctgttcagccatcattagcaggataaaagcttcaggtccacaatgtgtccttcgcctttgagctgatgctggacggaggcctcaagaaacccaaggctcgtcctgaaggactaaagcacagggtcatcccatggctgcttttggatcacagggagtcaggactccaagggcctcgagcgttacctggtccaggcccattttacagatgaaggcactgagccccaaatcacggaagtcacttagaggtcacagagcaagtgaaatgaacaaggtgtctgattcccaggaaggttcttgtccacataaagaaagtggcccaagacttccagggccccagagggagctgtcgggtccattaagtgttactggggtttttggtcccgacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaaagtccca

SEQ ID NO: 302330 - DNA, 929 bp, Homo sapiens
ctctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgaggtgagtgacctgcaggaagaaggcaagaatgccatcaactcaccgatgtcccccgccctggcggatgttcaccctgaagacacccagctcgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggtgaaggcagtgcatggaaaggatctgtgcactcactcactgggaatctttgaggagaagctgctcaccactcccgtctcccccattgcttccgctgccgcctgcctgagatcagggcctggcctcgtggttctccaggatcctttagttccacaag

SEQ ID NO: 302331 - DNA, 514 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (250)..(250): n is a, c, g, or t
gnggncncntgcaaaggccctacactttgacgtcctccccatctccggcagctccttaaactaagaactcattttaatttctgaattctccctttttaaagaccagataaatttacctttgggacagttagatgtgcacaaatgcaccatgtgtttaaagatcaccaaagaggagagaaaaggggattccttagtccagagaacaaaaactgcaggaggctggagctgagacgtgggtgttcctgcagcnggggcctgtgctcccaggcactcatggcttctctggctggttcacttctccctggctcagacagatcaggagtggaaacatctgaatatgctcaaggaggaggtaagttttgggggaaaaactgtcagaaagtggatgagggctgggtgcagtggctcatgcctgtaaccctagcactttgggaggctgaggagggaggattgttgcttgagcccaggaatttgagactactctgcacaacatagtgaaaacccatctatatga

SEQ ID NO: 302332 - DNA, 235 bp, Homo sapiens
gcctctgaagtttctctgtttccttctgcagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatcccca

SEQ ID NO: 302333 - DNA, 637 bp, Homo sapiens
ccaacagagcagggcttggagaggcagggtcccagctccacaggagagcattccattccatgacttcctcagctcccagatgggcctgaacatgcttacatgcttggtttgctttactggtgcattataaggagttataaggatcttcggagataacagatgtgcaaatgtccaggaaactgcagggttgctgggggcaaaaggaatccataatgggtgaacttgctgccccggtaaactgtttccctccatgcaagctggcagtgggggggatgcaccgaggtgtgtcccaaagaaggtgtgagagtgagctgcaaactcagaacctgtttcccctccatccctcagcccttcacaatggctcccttccagccctgccccaactctgtgcacctgtgcattaccagtatactcaggagctagacagacagacagaaagaaagacccagtctgcctcctgccgcggcctcatgggtgacagcagtctctgcctgggaatgagtgtgactggcaggagggagaagaacatggctcccagcaaggcttctgcctctggtcattctgggcagttccccctgtatgttgaagggaactggccagtgagatggcaggggtggccctggtgggcacagtgttg

SEQ ID NO: 302334 - DNA, 3617 bp, Homo sapiens
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaagtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggctttt

SEQ ID NO: 302335 - DNA, 4281 bp, Homo sapiens
  misc_feature (1574)..(1574): n is a, c, g, or t
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaanccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggctttt

SEQ ID NO: 302336 - DNA, 1040 bp, Homo sapiens
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaa

SEQ ID NO: 302337 - DNA, 1023 bp, Homo sapiens
cctgtctttagccactccccgtagtactgccaagctgctctctgtgcttgccccggtctttaccgagcttgccccgaagggattttgcttgccccaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302338 - DNA, 722 bp, Homo sapiens
  misc_feature (156)..(156): n is a, c, g, or t
  misc_feature (162)..(162): n is a, c, g, or t
  misc_feature (171)..(171): n is a, c, g, or t
  misc_feature (194)..(194): n is a, c, g, or t
  misc_feature (199)..(199): n is a, c, g, or t
aaccaaaagagcaacaattgccattacgccattaaggcttgggaacttatggaaaggcgattcggtggggcctgtattgcacagctgggaaaggggattggctgcaaggcgtttaagttggtaccgcaaggttttccagtcacgccttgtaacgcnggcatnaatggtatncactcctataggcgaatgggtcngggcncccctcgaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatcca

SEQ ID NO: 302339 - DNA, 636 bp, Homo sapiens
taaacatttaggcatatcatctttgatgtgaagtacttagaagttaattagatgataaagatattttatccttttgaccttgatatgtttatagtaatttatttaacagtgtaagaaagagcttgaaatttgctttattagcatagttataatcttatttaatctgaaggatgtttcttaatttcatattcagaaacatatcctaatttatcatttaaacactgatataaaaatatgtctacttagtaacctattttttcttaaggtatttactatgcaggatctattacaactcattaaaatcaaccctacttccagtctctacaaatcactggtttcaggatctgataaagaaaatcaaaaaggtaggagccgtcatctttgtagagaacagcaacagttttctatgtactttttcctctaaaagaatgaagcaaatttttagggagaagagtaaaatttaatttgatttaaattatttgatttctgcaggtcatttcccctatatttccatttttgtaataacttttagatattcaattaaaaaaactgtagacagtatcaaaggccctacagacaggctgaaagatactgtttgtaaaaatacccactgttgggaatatttctgcaaaaaaa

SEQ ID NO: 302340 - DNA, 4589 bp, Homo sapiens
  misc_feature (1574)..(1574): n is a, c, g, or t
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaanccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302341 - DNA, 4153 bp, Homo sapiens
  misc_feature (1574)..(1574): n is a, c, g, or t
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaanccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatcca

SEQ ID NO: 302342 - DNA, 4251 bp, Homo sapiens
  misc_feature (1236)..(1236): n is a, c, g, or t
gtgttatccctcgcgaacgtgttatccctcgcgaacgtgtatccctcgcgaacgtgttatccactataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaanccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302343 - DNA, 4714 bp, Homo sapiens
  misc_feature (1699)..(1699): n is a, c, g, or t
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaagccattaagtctgtgacttaatcgccaagtctcttggtagtaatgttagcagaatataaataaattggagcacaagatattctggactgcccgcaaactagaccatctctactgaagttcagtatggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaanccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302344 - DNA, 5358 bp, Homo sapiens
  misc_feature (1574)..(1574): n is a, c, g, or t
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaanccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaagggtaataagtatgacttgattctctgaactggttgctccattgtacacctttcgtaagtacattgagctcagggaggggagtcaattggtgtacaaagtcagaggtgcggcagatgccttaaaaggcatccctgtcctctccttgtcttaaaagcagtgggaaaggctgcacagaatgtgaagcttaggagttttgtagtaaaggatagtttttgaaggtaatttttgtacattctcatctgatccttaaaacaagcctgtaaaaaaggtagactgtgctttgctgcagaactttgctttgaaaacagggtttaaagaagagactgtcagtgccagctagctgggactagaacccaagggaggagtggctgccagttcacagttgcttccaggggcacacactccctccctccttcctctatttctcttcttgccttctgtgtcccaattctagtcctagcagatggattactctgtccacttaacacacctgctaagtcttgcttgaattactctaacatatgaatgttccttggactcttggttaattcaagtccaaagcacaggacacttgccaattaataccttccttcattgagatgacatatttgtcttcctttgatgatagcaatgacttcaattttaaaaattagtcctctggcatacaggctgtacttgaaggatcgggattaatattagtgcatttttaaaacacttaaaagttttacaaatgtatttgtgtattttctgttttggtgcctgttttatagaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302345 - DNA, 4922 bp, Homo sapiens
  misc_feature (1574)..(1574): n is a, c, g, or t
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaanccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaagggtaataagtatgacttgattctctgaactggttgctccattgtacacctttcgtaagtacattgagctcagggaggggagtcaattggtgtacaaagtcagaggtgcggcagatgccttaaaaggcatccctgtcctctccttgtcttaaaagcagtgggaaaggctgcacagaatgtgaagcttaggagttttgtagtaaaggatagtttttgaaggtaatttttgtacattctcatctgatccttaaaacaagcctgtaaaaaaggtagactgtgctttgctgcagaactttgctttgaaaacagggtttaaagaagagactgtcagtgccagctagctgggactagaacccaagggaggagtggctgccagttcacagttgcttccaggggcacacactccctccctccttcctctatttctcttcttgccttctgtgtcccaattctagtcctagcagatggattactctgtccacttaacacacctgctaagtcttgcttgaattactctaacatatgaatgttccttggactcttggttaattcaagtccaaagcacaggacacttgccaattaataccttccttcattgagatgacatatttgtcttcctttgatgatagcaatgacttcaattttaaaaattagtcctctggcatacaggctgtacttgaaggatcgggattaatattagtgcatttttaaaacacttaaaagttttacaaatgtatttgtgtattttctgttttggtgcctgttttatagaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatcca

SEQ ID NO: 302346 - DNA, 4478 bp, Homo sapiens
  misc_feature (1574)..(1574): n is a, c, g, or t
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaanccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatgtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302347 - DNA, 5304 bp, Homo sapiens
  misc_feature (1574)..(1574): n is a, c, g, or t
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaanccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaagggtaataagtatgacttgattctctgaactggttgctccattgtacacctttcgtaagtacattgagctcagggaggggagtcaattggtgtacaaagtcagaggtgcggcagatgccttaaaaggcatccctgtcctctccttgtcttaaaagcagtgggaaaggctgcacagaatgtgaagcttaggagttttgtagtaaaggatagtttttgaaggtaatttttgtacattctcatctgatccttaaaacaagcctgtaaaaaaggtagactgtgctttgctgcagaactttgctttgaaaggaggagtggctgccagttcacagttgcttccaggggcacacactccctccctccttcctctatttctcttcttgccttctgtgtcccaattctagtcctagcagatggattactctgtccacttaacacacctgctaagtcttgcttgaattactctaacatatgaatgttccttggactcttggttaattcaagtccaaagcacaggacacttgccaattaataccttccttcattgagatgacatatttgtcttcctttgatgatagcaatgacttcaattttaaaaattagtcctctggcatacaggctgtacttgaaggatcgggattaatattagtgcatttttaaaacacttaaaagttttacaaatgtatttgtgtattttctgttttggtgcctgttttatagaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302348 - DNA, 4115 bp, Homo sapiens
  misc_feature (1574)..(1574): n is a, c, g, or t
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaanccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctcctttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatcca

SEQ ID NO: 302349 - DNA, 4297 bp, Homo sapiens
  misc_feature (1282)..(1282): n is a, c, g, or t
tcacatgtgtgttcctgagtttcacaggattcagggatggggatctatctagatatcgaccgaggaatgtcaaggactgggactaggtccgtggtttgactagacgtcgggattgggtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtaagatggcttagtttctgtaatctactttggtttgttaattataactgaatagctgaataaaagtgaaatattttcttttaacaggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaanccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302350 - DNA, 3395 bp, Homo sapiens
  misc_feature (380)..(380): n is a, c, g, or t
tctatatccagtcccactaccagctggaactgcagtgctgcatcgactggacccatgtcactgacccccttcataggaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaanccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302351 - DNA, 1600 bp, Homo sapiens
  misc_feature (12)..(12): n is a, c, g, or t
tgcttgaggatncccaaaagccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302352 - DNA, 1470 bp, Homo sapiens
gggtctcagcgtgttagccaggatgatctcgatctcctgacctcgtgatccgcccgcctcggcctcccaaagtgctgggattacaggcgtgagccaccacgcccgacccatttcaatgtatttctaggaaattgctgtaacaagaagttgaagttttggtggaaatttcaagtagattcctgggaggaaaccagggttagatagttgatgttgaccagatacccaatgtgtggctactgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302353 - DNA, 1435 bp, Homo sapiens
catggctcagaacctcagggatgcgggccctgtgccctgctcctccaagggcctggaccatcccctactacaaggctgtgtgtccctggacaagttactccccttctctgggcctctgttccctgcttccacagggtgtgctgtgctggaagaactgatgctcagattgaatttcgtggtcttggcatcagctcccccctgatctctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302354 - DNA, 3158 bp, Homo sapiens
  misc_feature (1574)..(1574): n is a, c, g, or t
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaanccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctcagtgcttccacgacgtcattcctttctgccaagtgtgcccacttgaggctgctcagagtcgac

SEQ ID NO: 302355 - DNA, 1158 bp, Homo sapiens
  misc_feature (156)..(156): n is a, c, g, or t
  misc_feature (162)..(162): n is a, c, g, or t
  misc_feature (171)..(171): n is a, c, g, or t
  misc_feature (194)..(194): n is a, c, g, or t
  misc_feature (199)..(199): n is a, c, g, or t
aaccaaaagagcaacaattgccattacgccattaaggcttgggaacttatggaaaggcgattcggtggggcctgtattgcacagctgggaaaggggattggctgcaaggcgtttaagttggtaccgcaaggttttccagtcacgccttgtaacgcnggcatnaatggtatncactcctataggcgaatgggtcngggcncccctcgaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302356 - DNA, 1359 bp, Homo sapiens
gggtctcagcgtgttagccaggatgatctcgatctcctgacctcgtgatccgcccgcctcggcctcccaaagtgctgggattacaggcgtgagccaccacgcccgacccatttcaatgtatttctaggaaattgctgtaacaagaagttgaagttttggtggaaatttcaagtagattcctgggaggaaaccagggttagatagttgatgttgaccagatacccaatgtgtggctactgtctccagccctccggagcagaaagtgggtctttatcgaagacaaactgaacttcaagacaaaagtgaattttcagatgtggacaagctagcttttaaggataatgaggagtttgaatcatcttttgaatgtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatag

SEQ ID NO: 302357 - DNA, 1650 bp, Homo sapiens
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaacaaaatctgaagctctcgttcttcgggaaaagagtacccttgaaagaattcacaagcaccaagaggtggtatttacaaatattttatgggtggctatttcctgcagctattagtaggttggctcgagatccagcaacaggatggtacagttgatggaacaaggccccagaagagcaatagggactggggccaagagtgcaaatagaaggatggtccttgaaaaggatacacaaatttgcttcctctgagactgatggaaaggcgagaactgtggaggtgaacaatcaagttgggattatgagaaacacaccctaaataagctccatctcctcaggcagattagagggttagatcttgggttttaggagcagattggaggtgcagagtagttcctgtgggtaagggaagaacagccctttaaagcagagaggactgatcacctgtattgaggccaacgtggaggggggccggactgaaaggtcaccaggctgtaacaataacgacaatcagggaatgagattccaacccaaacgtgaaaggagaccgaaaacacagcctgtcaaaggacacaaaatggctgcgagagagggcagagcaacccacgagaccg

SEQ ID NO: 302358 - DNA, 466 bp, Homo sapiens
ttctcttttggagtgcatgtcttgtgagataattttattctgaagtaatcagtatggacaataaggaattagaacagtaattgaagttaaactattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatcca

SEQ ID NO: 302359 - DNA, 1018 bp, Homo sapiens
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggtaggagccgtcatctttgtagagaacagcaacagttttctatgtactttttcctctaaaagaatgaagcaaatttttagggagaagagtaaaatttaatttgatttaaattatttgatttctgcaggtcatttcccctatatttccatttttgtaataacttttagatattcaattaaaaaaactgtagacagtatcaaaggccctacagacaggctgaaagatactgtttgtaaaaatacccactgttgggaatatttctgcaaaaaaa

SEQ ID NO: 302360 - DNA, 1105 bp, Homo sapiens
gaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtaagatggcttagtttctgtaatctactttggtttgttaattataactgaatagctgaataaaagtgaaatattttcttttaacaggtttcaggatctgataaagaaaatcaaaaaggtaggagccgtcatctttgtagagaacagcaacagttttctatgtactttttcctctaaaagaatgaagcaaatttttagggagaagagtaaaatttaatttgatttaaattatttgatttctgcaggtcatttcccctatatttccatttttgtaataacttttagatattcaattaaaaaaactgtagacagtatcaaaggccctacagacaggctgaaagatactgtttgtaaaaatacccactgttgggaatatttctgcaaaaaaa

SEQ ID NO: 302361 - DNA, 471 bp, Homo sapiens
ctctctgccttagcacttagagagtaggaagagactccagtattttctgacttaaactgtactcttggctttctttttcctctaacatttcatgatgaacattttcaaacatacagaaaagttgaaacaattttagcgaacacttgtatacccaccacctagatgtcactattacacttgtgttatacttgcttcatcatttttatctgtccatccattcatccaccttcctttttttgtatttcaaagtaagttgcagataatccctacactttcccctaagtatcctctttacttttgaaccagaggtctggcgtcttacgcacctgacgatgtttctatgtcctaatttgatgtgttattttttaatagctgagaagcttcagcttattgatgatcagtttgcagatgcttaccctcagcgtatcaagttcgaatctttagaaataaagctaaatgagtataagagag

SEQ ID NO: 302362 - DNA, 368 bp, Homo sapiens
gtgtgattattgttgggttcttggttgcctctggaaaatgggatgataatcttagaaggacttgcttcatgggatgcggcctataaaagttctgccccaactgtagggcggaagataattttcgttattgtagttagagtcttattgtagagaatcagacttctgtctagtgaccttaattaaattgtgacaccatgcttaaaggagcctgccagcttttacttttgcagtactgtaaagtcattattcaaatgtaaattttcctttttgaattttagcttgaattagagtctgtcaaagcccagtctttggcaataacaaaacaaaaccatatgctgaatgaaaaggttaaagagatgagtgattat

SEQ ID NO: 302363 - DNA, 2205 bp, Homo sapiens
cccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagtaagtccctgtggcattgggattcgtacttttattaagaataatttttaaatcgtttttattacattgcttactccacattgctctccaggcctgttttttaattcgtgcacacacacacacacacacacacacccctatatttgactcccctcccccactccctacgttggttctgggtcctccaccctaactcctgggtgggtgttttttgggagggggaaggggagcgcctgtagttgtatgaatgacagtgtccgccatattgatcagaacatcacactattggcatgattatgatcattactcttgcttgtggaatattttctgtgtctcactgcctccatttctgtctgtgtctctgtttcattctgtctctatttctttctcctcttccctccatacctccctatcccccaaggtccgtaatcccacttccccctgctcttttcctggggcagtgattttgaacttggctaacatggaggggacccagccctagactggggtggaggatcaagtgtctgctgttcatgcgtttggtgctgaattggaggctgtggtttctacatcccctcgcaccccctcccccgcaaaaaaagagggccagggttaggggaggggtcgtgtgctaggggaaggagtgggtttccaaacgtaggtgacgggcacagttttatccaaggtagaggtggaagggggagggaagctgcctgtgaggctgaatgtccgccccttgctgcccccagctcctctcctcccccaccctcccagcattgctctcctgacacccgcagttttcgttcgctccgtggcctttatcagtgtatttatttacactctgcataggccgtgttccatgtaatctacccacaatgcggatttcaggccccacttgccgccgcccccttctgccttagctatcagtttcccctcctaattaactgggggtggatttgagtgatggttgaaaattaaaacaaaatgggatattccttcccttccacactttctcaataaggagcctcgcccctcctttccacttgcaggctcgcttcttgccctatccactcggcagttcctggtgatccccaggcaggtttgcttggggagggggtggccggcagcgaaggggtgtgcgccctccgggcctcctgtttcggttggcctgtcagttcgagacggaggagttcgtttagaccgtttagcgaagattccacgtcgctttgctgtgacaccttcgtgcacacacagctcctaattaggggttgctgtg

SEQ ID NO: 302364 - DNA, 1436 bp, Homo sapiens
tttaagctacaaagcacatgagaaatgttctgtttttcctttaaaatcaaagaaaatggtcagactggaccccttatctctctctctacagactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttcctttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaagaggaggcaaaaagacaaaacacacaaaaaattaaaaaaaaaaacttaaaaaaaaaaggaaaaaagaaaaaaaagcccacgggtctttgtaagcctttctattcccaatcggtgaggtttctgtgatatcttacacactgccagtctacttctctgactaatggaaaattcctgtgtagctcaataaaagagaatgtttgtctgtactcc

SEQ ID NO: 302365 - DNA, 1068 bp, Homo sapiens
cccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaaatatccattgagcttctactctgtaccgagcaccatcttaagtgttgtaactgagcaagacacacaaaatctctgccctcctggagtgttctgacattcttgttaggggagacaggcaataaataaggaaaatacatag

SEQ ID NO: 302366 - DNA, 593 bp, Homo sapiens
agaaattactggacaggtagcttccagataagagtgatgaactatcatttctgacaaaagatgttggacaggctgtggcagcaaggaggtgatcagaagactccctagagcacaggggatctggcaggctttttctataaaatgacatggatacacacagggtcaggctgcctgtgggcagagacgtccccaggagccctgcccggtggccagcaccacggacatctgctcacctgtggcagaactcggagtctcacagctaagccaggccagacccagttgctactttttggtcaagacccgctctaggaattcttccagggaagagggaatgtgaatttgtctgttttcagatatgtgtagcctttacacaaaagtgtttgaaattatttggttaaaatgctttccatcgaggttattctttctttcttcttttttttttcccactctgcagatatccattgagcttctactctgtaccgagcaccatcttaagtgttgtaactgagcaagacacacaaaatctctgccctcctggagtgttctgacattcttgttaggggagacaggcaataaataaggaaaatacatag

SEQ ID NO: 302367 - DNA, 3206 bp, Homo sapiens
cccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttgactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttcctttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaagaggaggcaaaaagacaaaacacacaaaaaattaaaaaaaaaaacttaaaaaaaaaaggaaaaaagaaaaaaaagcccacgggtctttgtaagcctttctattcccaatcggtgaggtttctgtgatatcttacacactgccagtctacttctctgactaatggaaaattcctgtgtagctcaataaaagagaatgtttgtctgtactcc

SEQ ID NO: 302368 - DNA, 4237 bp, Homo sapiens
  misc_feature (2142)..(2142): n is a, c, g, or t
cccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataaactttaaagaggcataacaaaaccttatatatatatatatatatacaaatatatatttaaaaaatctttttagtttgtactagaaagagctgcggacagaactgaccaccatcccatagctcatggaggttttcctgggacggcacgtgagcatgcacgtgtgtgtgtgtacacacactncacacatgtccagatgggagcttggtttgggagtccctccttttgaggatagccccggggtgttcctctcagccccatttctgagaacaggtgaatggcagaacagccctggccttggcccagccagctctctgtgttgcgcccttagagcctctgcgccctcagttccgtcctgctcttggcaaattccagaccctttcagaaatggccgaagccctaagcctctcctcactctgcactcccaaaaacagaacaatttaaggatgcttctctttcgggtggtggtggttgttaatttcaggaatttagaagaatcattgctccgaccaaatccactgtctcctgagttttctttattcatgttaagatggcaagaatcagagaacagggagacttggtctgctttctaaaagcagctgacaggaggggactcaagttcacctgcagagttgaaaccagccccgctccaagagggcatgtgggaaggtggggagcgaggggaacaggcgtggcggggagggccggacttgtgggcctgacccgagtcagggtctcaggggggggccaggcttccccaggtgcccgggatgggccttcaaatggggttccctgaaccccctcgtgctgctgccccatctcgccccaacccccagcagtagtcaaaatgttcctagggttttttggttggttggttggtttttaaaatcaaagaaaatggtcagactggaccccttatctctctctctacagactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttcctttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaagaggaggcaaaaagacaaaacacacaaaaaattaaaaaaaaaaacttaaaaaaaaaaggaaaaaagaaaaaaaagcccacgggtctttgtaagcctttctattcccaatcggtgaggtttctgtgatatcttacacactgccagtctacttctctgactaatggaaaattcctgtgtagctcaataaaagagaatgtttgtctgtactcc

SEQ ID NO: 302369 - DNA, 4083 bp, Homo sapiens
  misc_feature (1988)..(1988): n is a, c, g, or t
cccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataaactttaaagaggcataacaaaaccttatatatatatatatatatacaaatatatatttaaaaaatctttttagtttgtactagaaagagctgcggacagaactgaccaccatcccatagctcatggaggttttcctgggacggcacgtgagcatgcacgtgtgtgtgtgtacacacactncacacatgtccagatgggagcttggtttgggagtccctccttttgaggatagccccggggtgttcctctcagccccatttctgagaacaggtgaatggcagaacagccctggccttggcccagccagctctctgtgttgcgcccttagagcctctgcgccctcagttccgtcctgctcttggcaaattccagaccctttcagaaatggccgaagccctaagcctctcctcactctgcactcccaaaaacagaacaatttaaggatgcttctctttcgggtggtggtggttgttaatttcaggaatttagaagaatcattgctccgaccaaatccactgtctcctgagttttctttattcatgttaagatggcaagaatcagagaacagggagacttggtctgctttctaaaagcagctgacaggaggggactcaagttcacctgcagagttgaaaccagccccgctccaagagggcatgtgggaaggtggggagcgaggggaacaggcgtggcggggagggccggacttgtgggcctgacccgagtcagggtctcaggggggggccaggcttccccaggtgcccgggatgggccttcaaatggggttccctgaaccccctcgtgctgctgccccatctcgccccaacccccagcagtagtcaaaatgttcctagggttttttggttggttggttggtttttaaaatcaaagaaaatggtcagactggaccccttatctctctctctacagactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttcctttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaagaggaggcaaaaagacaaaacacacaaaaaattaaaaaaaaaaacttaaaaaaaaaaggaaaaaagaaaaaaaagcccacgggtctttgtaagcctttctattcccaatcggtgaggtttctgtgatatcttacacactgccagtctacttctctgactaatggaaaattcctgtgtagctcaataaaagagaatgtttgtctgtactcc

SEQ ID NO: 302370 - DNA, 2848 bp, Homo sapiens
  misc_feature (2142)..(2142): n is a, c, g, or t
  misc_feature (2476)..(2476): n is a, c, g, or t
  misc_feature (2509)..(2509): n is a, c, g, or t
  misc_feature (2542)..(2542): n is a, c, g, or t
  misc_feature (2544)..(2544): n is a, c, g, or t
  misc_feature (2546)..(2547): n is a, c, g, or t
  misc_feature (2555)..(2555): n is a, c, g, or t
  misc_feature (2560)..(2561): n is a, c, g, or t
  misc_feature (2564)..(2564): n is a, c, g, or t
  misc_feature (2579)..(2579): n is a, c, g, or t
cccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataaactttaaagaggcataacaaaaccttatatatatatatatatatacaaatatatatttaaaaaatctttttagtttgtactagaaagagctgcggacagaactgaccaccatcccatagctcatggaggttttcctgggacggcacgtgagcatgcacgtgtgtgtgtgtacacacactncacacatgtccagatgggagcttggtttgggagtccctccttttgaggatagccccggggtgttcctctcagccccatttctgagaacaggtgaatggcagaacagccctggccttggcccagccagctctctgtgttgcgcccttagagcctctgcgccctcagttccgtcctgctcttggcaaattccagaccctttcagaaatggccgaagccctaagcctctcctcactctgcactcccaaaaacagaacaatttaaggatgcttctctttcgggtggtggtggttgttaatttcaggaatttagaagaatcattgctccgaccaaaaanaaaaaaaaagaaaaaaaaaaaagggggggcccngccagaatcttcccctcgcgagggggccccaanancnnaccgccgnacccnnagntttctgtggccacanaggggtgtgccccaatagagtgagaagacgaattagcataagcataaggcgacgtggccgcgaccgcgaattacaagcaaagcgccgcggagaacctgggggcaaacaaccggcctaacgaccgggcgacaacctctgggtgaacaaagggaaacacctataacatatcgcgggggggggggggaggaaccaataaaggggggcaacacaacaatacaccctctaccggcagttttaaaaacgcccccaaagaggcactacacattaaa

SEQ ID NO: 302371 - DNA, 2635 bp, Homo sapiens
  misc_feature (2142)..(2142): n is a, c, g, or t
  misc_feature (2495)..(2495): n is a, c, g, or t
  misc_feature (2501)..(2502): n is a, c, g, or t
cccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataaactttaaagaggcataacaaaaccttatatatatatatatatatacaaatatatatttaaaaaatctttttagtttgtactagaaagagctgcggacagaactgaccaccatcccatagctcatggaggttttcctgggacggcacgtgagcatgcacgtgtgtgtgtgtacacacactncacacatgtccagatgggagcttggtttgggagtccctccttttgaggatagccccggggtgttcctctcagccccatttctgagaacaggtgaatggcagaacagccctggccttggcccagccagctctctgtgttgcgcccttagagcctctgcgccctcagttccgtcctgctcttggcaaattccagaccctttcagaaatggccgaagccctaagcctctcctcactctgcactcccaaaaacagaacaatttaaggatgcttctctttcgggtggtggtggttgttaatttcaggaatttagaagaatcattgctccgaccaatgaaatacagatagatagacaanaataannaagaaaatagtggggggcccggaacataattgatttccccctccgggaaggcgtgccgcctgactagcttctccgcgctatttcccccgaggcttcttctttgtgcacacaagagggtggcccccaataatag

SEQ ID NO: 302372 - DNA, 1646 bp, Homo sapiens
cccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacggacacgacctgcactggcacgaatccctgaagcttgatgatcagattcgaaacaacaaatgggtacaaaacggtactaatcaaccgtggttgtaacagaaggatatactgaatagagtagatcagagttgtcccagtccgaccacgcgtcaggga

SEQ ID NO: 302373 - DNA, 1427 bp, Homo sapiens
cccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggtaggcccctgagcccataagcacagcaacaagaggttctgtctgtgttaccccactgcctcctctttatagtgctgggctgccttaaatgaacgagaagagactccgctatgtttgaaagatatatggtggcacagtcaccaacctaagccattgcatccacccctctggcaaactcccagcaaactcaccaactttgcaagttgcaggggctacaaaactcccggatttattttgcagatgaggaagagttggtgacagttctaaattggagctgccacaacactgtctaagtacctgtccttgggcaattaacttgtacagaaaaaaatatgtattaaacaaaacaagccttg

SEQ ID NO: 302374 - DNA, 215 bp, Homo sapiens
cgacgcgtgcccacgcgtccggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302375 - DNA, 337 bp, Homo sapiens
cttcttcctcctccttaagcctctgctcctcgtcctgtttgtccttcatttgtttctctgctgccttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaagcagcagagaaacaaatgaaggacaaacaggtccagggcagaggaccaacgtcgacgcggccgcgaatttagtagtagtagcc

SEQ ID NO: 302376 - DNA, 477 bp, Homo sapiens
  misc_feature (157)..(157): n is a, c, g, or t
aactcgggaccccctttgttgtatccgtggtggtaactgtgggtcactgcctgtgcacgggattgccagtaattggaggaggatatgatagcacagataatctctgtcagaactgtgacaaatcaaaggcggtcccggtttaacccgggaccccctntgattcagaacctgagtacaaggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaagcagcagagaaacaaatgaaggacaaacaggcctctggagttggacaggcctctggagttggg

SEQ ID NO: 302377 - DNA, 1839 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302378 - DNA, 2327 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctccaaaaaaaaaaaaaaaaaaaaaaaaaaaaaagagggggggcgcgccccaagaagtttcccccgcggggggccccagttttccgcgcgttccccggttttttgtgttccaagggtggtcccctattggggggagcccgctattatattagagccatgaggccagcggggccgcgcgcggttttcaccaacgcgttcggggactgtggggaagacacgcggccttagccgtgggggcacccttctgtggggaagggaaccctttactttcgtggggcgtgggcacttatttgggcccaaattctacctctccgagagagatataaaaggctctccaaggggaactttacttaacatttttaagcggggtgttttacggggtgttaacacctatgggtggaattatgcctggcgggtctggaaaggtttgggcctaagcggggtattggattttgtgacaacttttttccgcgggctttttgacataaatac

SEQ ID NO: 302379 - DNA, 2275 bp, Homo sapiens
  misc_feature (2063)..(2063): n is a, c, g, or t
  misc_feature (2170)..(2170): n is a, c, g, or t
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctccaaaaaaaaaaaaaaaaaaaaaaaaaaaaaaaaaaaaaaaaaaaaaaaaaaaaaaaaaaaaaaaaaaaagtgggggggtttttttgtggggtggcggggaaaaacaggggtataagtagaaaggtgggcgccacgtgtgtggtccgatgtagggtgtgtttcctgtgagacccaagattttttcttgtgtacaacaaaggggtgtggtaaatatctcgtgggggngagcgtctcgcacctaatagtaagggggagagcgaccgagttatttaaaatatctttcgagagaataagacgcacgccaggtgattatgcccacgcgtttgtttatnttatgttaaactagctcgatgctgaaggacagaaagtagtgcgaatccgatacttagacacagagaagtcagaatgagaactgattggactatatcaacatgagg

SEQ ID NO: 302380 - DNA, 1816 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302381 - DNA, 1863 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctccaaaaaaaacctgcagcccggggga

SEQ ID NO: 302382 - DNA, 1880 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcctccctcctgtgtctccttctggggaaagacagacttaagga

SEQ ID NO: 302383 - DNA, 2245 bp, Homo sapiens
  misc_feature (2033)..(2033): n is a, c, g, or t
  misc_feature (2140)..(2140): n is a, c, g, or t
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctccaaaaaaaaaaaaaaaaaaaaaaaaaaaaaaaaaaaaaagtgggggggtttttttgtggggtggcggggaaaaacaggggtataagtagaaaggtgggcgccacgtgtgtggtccgatgtagggtgtgtttcctgtgagacccaagattttttcttgtgtacaacaaaggggtgtggtaaatatctcgtgggggngagcgtctcgcacctaatagtaagggggagagcgaccgagttatttaaaatatctttcgagagaataagacgcacgccaggtgattatgcccacgcgtttgtttatnttatgttaaactagctcgatgctgaaggacagaaagtagtgcgaatccgatacttagacacagagaagtcagaatgagaactgattggactatatcaacatgagg

SEQ ID NO: 302384 - DNA, 1872 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctccgtcgacgcggccgcgaatttagtagtagtagcc

SEQ ID NO: 302385 - DNA, 1863 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctccaaaaaaaaaaaaaaaaaaaaaaaa

SEQ ID NO: 302386 - DNA, 1713 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302387 - DNA, 1700 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggaatgttttcatgttacttatactaacattagttcttctatagggtgatagatct

SEQ ID NO: 302388 - DNA, 1653 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctcaggactgggccacttctgggtggggcagtgggtcccagattggctcacactgagaatgtaagaactacaaacaaaatttctattaaattaaattttgtgtctcc

SEQ ID NO: 302389 - DNA, 1927 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302390 - DNA, 1538 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccgcctaccacacattcgaagaacccgtatacataaaatctagacaaaaaaggaaaaaaaaaaaaaaaaaaaaaaaaaaaaaaaaaaaaaaaaaaaaaaaaaaaaaaaaaaaaaaa

SEQ ID NO: 302391 - DNA, 1636 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccgccgactcgtccgcgcagaccgccatgcaccgcgacgcgcatggagctggtggggatataatcagacggcccgtggaatgccttcgtggtggcactctccaactgcatgatgctgctggctcgacgctgcgtgtccattgaggcaagcatgctgagcctatgtccctggtcccgttgcgctgcactgccgtgggggtctgtccagctgggtg

SEQ ID NO: 302392 - DNA, 1486 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctccccctcatcctcatcttgtcctcatcatcctcctgtcctctgcctcctcctcctctttggttctgc

SEQ ID NO: 302393 - DNA, 1737 bp, Homo sapiens
  misc_feature (1354)..(1354): n is a, c, g, or t
  misc_feature (1386)..(1386): n is a, c, g, or t
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaaancccctttttttttcccactttttttttttttntttcccaccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302394 - DNA, 1641 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagatcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302395 - DNA, 2129 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagatcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctccaaaaaaaaaaaaaaaaaaaaaaaaaaaaaagagggggggcgcgccccaagaagtttcccccgcggggggccccagttttccgcgcgttccccggttttttgtgttccaagggtggtcccctattggggggagcccgctattatattagagccatgaggccagcggggccgcgcgcggttttcaccaacgcgttcggggactgtggggaagacacgcggccttagccgtgggggcacccttctgtggggaagggaaccctttactttcgtggggcgtgggcacttatttgggcccaaattctacctctccgagagagatataaaaggctctccaaggggaactttacttaacatttttaagcggggtgttttacggggtgttaacacctatgggtggaattatgcctggcgggtctggaaaggtttgggcctaagcggggtattggattttgtgacaacttttttccgcgggctttttgacataaatac

SEQ ID NO: 302396 - DNA, 1417 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaattggctcacactgagaatgtaagaactacaaacaaaatttctattaaattaaattttgtgtctcc

SEQ ID NO: 302397 - DNA, 1626 bp, Homo sapiens
ctctagaggatcttgggctcagtgatcctcggcagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302398 - DNA, 1832 bp, Homo sapiens
  misc_feature (844)..(844): n is a, c, g, or t
  misc_feature (861)..(861): n is a, c, g, or t
  misc_feature (864)..(864): n is a, c, g, or t
  misc_feature (876)..(876): n is a, c, g, or t
  misc_feature (885)..(886): n is a, c, g, or t
  misc_feature (888)..(888): n is a, c, g, or t
  misc_feature (894)..(895): n is a, c, g, or t
  misc_feature (916)..(916): n is a, c, g, or t
  misc_feature (918)..(918): n is a, c, g, or t
  misc_feature (936)..(936): n is a, c, g, or t
  misc_feature (959)..(959): n is a, c, g, or t
  misc_feature (962)..(962): n is a, c, g, or t
  misc_feature (964)..(966): n is a, c, g, or t
  misc_feature (970)..(970): n is a, c, g, or t
  misc_feature (973)..(973): n is a, c, g, or t
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggaagccccggcagagcgncaacccataggacaagngtncggggatcctcntagaaaggnncnaccccnnggaggcgccctagcccatgancnagcccgagtagaacgggncccgttggccctggcaccgcgtncantnnnaggnggncattagcgggtacaatttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302399 - DNA, 1738 bp, Homo sapiens
  misc_feature (1295)..(1295): n is a, c, g, or t
  misc_feature (1298)..(1298): n is a, c, g, or t
  misc_feature (1342)..(1342): n is a, c, g, or t
  misc_feature (1344)..(1344): n is a, c, g, or t
  misc_feature (1377)..(1377): n is a, c, g, or t
  misc_feature (1396)..(1397): n is a, c, g, or t
  misc_feature (1402)..(1406): n is a, c, g, or t
  misc_feature (1420)..(1420): n is a, c, g, or t
  misc_feature (1422)..(1422): n is a, c, g, or t
  misc_feature (1438)..(1442): n is a, c, g, or t
  misc_feature (1444)..(1445): n is a, c, g, or t
  misc_feature (1463)..(1463): n is a, c, g, or t
  misc_feature (1477)..(1477): n is a, c, g, or t
  misc_feature (1533)..(1533): n is a, c, g, or t
  misc_feature (1562)..(1562): n is a, c, g, or t
  misc_feature (1599)..(1599): n is a, c, g, or t
  misc_feature (1609)..(1609): n is a, c, g, or t
  misc_feature (1621)..(1621): n is a, c, g, or t
  misc_feature (1623)..(1624): n is a, c, g, or t
  misc_feature (1627)..(1627): n is a, c, g, or t
  misc_feature (1630)..(1630): n is a, c, g, or t
  misc_feature (1658)..(1658): n is a, c, g, or t
  misc_feature (1672)..(1672): n is a, c, g, or t
  misc_feature (1682)..(1682): n is a, c, g, or t
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaccccngcncccccccccccgcagccgcccccccccccaaacaaccccccccncnaaaccccagaactttcatttttttcccaccctngttcccatttaaaaaaaannccccnnnnnaaaccccccccccncncccccccccccccacnnnnntnntttttttttttttttttnaacaccaaaatttnatcttatatatgtcatactctttcgagctcgcttcgacccctcgattctccatctntcagcgaactacatctctcccctgccccncgccccgcatgctccccactcctggcgtgcgccacgngcgcgaaccnggggcggcgagngnngtnganaagccccacggcctcgcacgcaagtcgntcgggcggcgtccnacccagcgcncccccgagcagctccccacgctacgtggggccgcgcatcacacgaacgccgcccag

SEQ ID NO: 302400 - DNA, 1498 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302401 - DNA, 1406 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302402 - DNA, 1898 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgttgtatgtctgatcccgtgcatgtctgtctggtccaaactattaggaaacagcttcatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302403 - DNA, 1769 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaaggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302404 - DNA, 1281 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggctagagagagagaggaaagaaagaaagaaagaaaaagaaagaaagaaagaaagaaaagaaagaaagaaagaaagaaagaaagaaagacagcaacagcaggagaaacagcagaagaaaaaaagaagaagaaaaagagagaaagaaaaaaacagaaacaaaaaaacaaacggagag

SEQ ID NO: 302405 - DNA, 1934 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302406 - DNA, 1144 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaagcagcagagaaacaaatgaaggacaaacaggtccagggcagaggaccaacgtcgacgcggccgcgaatttagtagtagtagcc

SEQ ID NO: 302407 - DNA, 1118 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaagcagcagagaaacaaatagaaggacaaacataaccgaggcgtgcaattgagatcctc

SEQ ID NO: 302408 - DNA, 1124 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaagcagcagagaaacaaatgaaggacaaacaggcctctggagttggacaggcctctggagttggg

SEQ ID NO: 302409 - DNA, 1029 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcagcaagtctggcaccatcacttgacactcgatttccggtttatgggatactctagatcacca

SEQ ID NO: 302410 - DNA, 988 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattcagaacctgagtacagggtgagtggaagccccgcagatcgacaacccagatacaagggcacttgatccacccagtgctggt

SEQ ID NO: 302411 - DNA, 1634 bp, Homo sapiens
  misc_feature (844)..(844): n is a, c, g, or t
  misc_feature (861)..(861): n is a, c, g, or t
  misc_feature (864)..(864): n is a, c, g, or t
  misc_feature (876)..(876): n is a, c, g, or t
  misc_feature (885)..(886): n is a, c, g, or t
  misc_feature (888)..(888): n is a, c, g, or t
  misc_feature (894)..(895): n is a, c, g, or t
  misc_feature (916)..(916): n is a, c, g, or t
  misc_feature (918)..(918): n is a, c, g, or t
  misc_feature (936)..(936): n is a, c, g, or t
  misc_feature (959)..(959): n is a, c, g, or t
  misc_feature (962)..(962): n is a, c, g, or t
  misc_feature (964)..(966): n is a, c, g, or t
  misc_feature (970)..(970): n is a, c, g, or t
  misc_feature (973)..(973): n is a, c, g, or t
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggaagccccggcagagcgncaacccataggacaagngtncggggatcctcntagaaaggnncnaccccnnggaggcgccctagcccatgancnagcccgagtagaacgggncccgttggccctggcaccgcgtncantnnnaggnggncattagcgggtacaatttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagatcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302412 - DNA, 955 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagcagaagcaggaagcagcgggaagcaggaagcggcagaagcaggggcagaagcaggggcagaagcaggaagcaggaagtaatgtaatttggtttgatatagaggaataatccaagttaagatggaatcattaagcagaagtcaaacagtgcataaggaattgtcatgta

SEQ ID NO: 302413 - DNA, 650 bp, Homo sapiens
  misc_feature (21)..(21): n is a, c, g, or t
cccgggcccggggcccggggnaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302414 - DNA, 912 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaatgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302415 - DNA, 821 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttgaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302416 - DNA, 1672 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaacggagatggatacggccagatggttcccagatcactggttggagcgagttctctccgtgaaaccgcggtaaatggggggccatgactaatgagaccggacgatacggccacagctcctcttttccgcgctcccttcgggtcctccctcgcccaacgcacaacacggagagaacacgccaagagcaagaacgacaaaagaacgacgaacaaagaagatgagacacgcgtgacgaggaacgaagacaaacacagaagagagacgcaacatcgagcacgagagaaacagcaggaggcgaggacgaggacgaagaaggcagagagcaagcggacaagaacagaggaaagaaactaaacaagaacagacagaaggaagaagacgacaaacagggaaaaaacgagaacacagaaacaaaaacaagcgaacaaaacgaagaaaataacgacaaagaaacgcaagacaaaaggaagaaaaaagaaaaaagaaaagcaaaacaagagaacacgcgagaaacaaagcagacagaaacagacagaagcagggcgaaaagaagcgagaagagagtaagcatgacggaagagaagcagagaagagaagagcagagcgaagaaaaagaggagaatatgagaaggcagaagccagggaacagacgaagagcagagaggaaaggagcgagatggcacagaggaggaggcagcaggagagaggacgcagcgatgaccggaagcgcaagacggaggaggagggaggaaataacagaaagaagcagaaccgagacaaagaggagagggaagagcaagacaacacaagaactaagaacagagaaaagaaaatagcagagaacaaacgagagagagagaggaaagaaagaaagaaagaaaaagaaagaaagaaagaaagaaaagaaagaaagaaagaaagaaagaaagaaagacagcaacagcaggagaaacagcagaagaaaaaaagaagaagaaaaagagagaaagaaaaaaacagaaacaaaaaaacaaacggagag

SEQ ID NO: 302417 - DNA, 711 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattaggactgggccacttctgggtggggcagtgggtcccagattggctcacactgagaatgtaagaactacaaacaaaatttctattaaattaaattttgtgtctcc

SEQ ID NO: 302418 - DNA, 1037 bp, Homo sapiens
agaggtatcccttcctgattcgcgaagactagcttgcgcatcctctggctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaaccagccaccttgtgtcctgtagtcattgtcccccttttataggatcccccctgtcggacttcgtccagttgcacttccaatgtccctggagccaccatccgattatccatcaccttggttatttttgtcacccgagaaaggatagatgcctgttcagcagaattgggagcccggtcctgattcctcttcagcaaggcctcactgaaggaagtttcatcaggtgctggcttgacccggggaaaggccctttcacaccaatagaagtccaatgggatatgtggtaccaagggcctgaaccctcctcctgggcctcctctggaacccaagcgccccccacgaccacggcctctgtaccctgaatgagccccaa

SEQ ID NO: 302419 - DNA, 542 bp, Homo sapiens
ctctagaggatcttgggctcagtgatcctcggcagtttcgagcctttcagcaacaaaggccagacgctggtggtgcagttcacggtgaaacatgagcagaacatcgactgtgggggcggctatgtgaagctgtttcctaatagtttggaccagacagacatgttgtatgtctgatcccgtgcatgtctgtctggtccaaactattaggaaacagcttcatgcacggagactcagaatacaacatcatgtttgtcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 302420 - DNA, 1113 bp, Homo sapiens
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgca

SEQ ID NO: 302421 - DNA, 1136 bp, Homo sapiens
  misc_feature (25)..(25): n is a, c, g, or t
  misc_feature (33)..(33): n is a, c, g, or t
  misc_feature (40)..(41): n is a, c, g, or t
  misc_feature (53)..(54): n is a, c, g, or t
aagcaacaccgatgcaatatatggntacactantgaaccnngtgggggttaannaaagcagctgtacgcccggatttcggatgcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgca

SEQ ID NO: 302422 - DNA, 1348 bp, Homo sapiens
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgcaaaaaaaaaaaaacaaacagacagagcaaaaacaaaaaggggcggcgagaccagagtgggcgaatacggggagaaaaggaggcccacgagggtggtccacagagccgcggagaaaaaggaataagaagagaaacagacacagacaaagtatcggcaataccacgagagaaaggcgccacaaaacagcacaaggacagggaaaaacacaggggaaagagcaggaggagataaaaggc

SEQ ID NO: 302423 - DNA, 1612 bp, Homo sapiens
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgcatttccccattcttttttttttccctgtctccgtgacaaccagtggttcttcatttttgatcatgcgaaatgcattttgacccagatggtctgcagaacttcacttaggacattagcacacaaatagcacacatatcacatacccatttatatacataattagaaaatgttcctgatacatgtgtcatgtgatttcttccaacaaatgttttggaaaacagcaagcaactagtctgtaggttgtcttttctctagagatccttgtcctgggacagcctggggcaagttattaagcatatttccttcctggtgggctagatgatgtgcattatacctgtagtaccttcatactagcccttacaagttaaatgtcctgtggccatcttagccgaaagtctttggttgcaaaatcttataggtaaaaacagttgaaagaacattatgggatttccttgcttgttctgatacaatacaactagatgaccttaaaaaccctcata

SEQ ID NO: 302424 - DNA, 1184 bp, Homo sapiens
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgcaaaaacacaacacccctccgaacgcccgtcgaaaaaacaactcgacgcggcccgcaatttagtcctagtatc

SEQ ID NO: 302425 - DNA, 919 bp, Homo sapiens
  misc_feature (815)..(815): n is a, c, g, or t
  misc_feature (819)..(819): n is a, c, g, or t
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaacccttaaattttggnaggngggtcaaattttcccccaacctggagggggggtctctaaaaaaggaaactgtccgtggagccgcgtaacttgggggaaacaggagggggtccacaaaaag

SEQ ID NO: 302426 - DNA, 1287 bp, Homo sapiens
  misc_feature (1117)..(1117): n is a, c, g, or t
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaactcttgcaggcaagggctttatttcgaaaagggaaaaggtttttgtaccctgtggaagcacccccgcctctaagggccctttttgttaaggtctaacaggcctctcgggaatggtggccgtttcagctctttatcaaattccggtggggatccagactgtacagtttactgtgggcgcgatctcttaaagaaaaccttgtccgcttctaatctccctagtctgcgtcatctgcctctccgctcattctctctcgcctcgctcgccctctctccctcatctcctcgtctctccattccaacaataaccgctgcgctcnccatcgtcactcgctatatcactctctcgactctcgctgtctcgtctcactagtgggcgaacactcgcgcgtctctatactctgttcaccactgcgtctccacatcacttggatctactctcgcgcgctgctataacctcgatctctggcgtctcatatgtgcgtggcgc

SEQ ID NO: 302427 - DNA, 961 bp, Homo sapiens
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaacgcaaatgacaacctgggggggggcccgggaccaattggccaatatgagtgctattcatcacgtgcgcgtttttaaactttgtgggcgtggttcacattaagctgtaggatatcccttgaagcagagattccgccatggtctccacgtgcgcagagagcag

SEQ ID NO: 302428 - DNA, 1311 bp, Homo sapiens
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagtgagtttcagggtggggctgcccggcgtggcgcgagtcgaagaaagaccgctgggcctcaggtggtgggtagattaggcccgaaaaactgcggggtgcgggcgtgcgtatagtcgcggaaggttgtgtgtttcgaagctttgaggagctgaggctctggaaggcttgcggatcgcctggaagccacgatgtgagatggaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgca

SEQ ID NO: 302429 - DNA, 1035 bp, Homo sapiens
  misc_feature (25)..(25): n is a, c, g, or t
  misc_feature (33)..(33): n is a, c, g, or t
  misc_feature (40)..(41): n is a, c, g, or t
  misc_feature (53)..(54): n is a, c, g, or t
aagcaacaccgatgcaatatatggntacactantgaaccnngtgggggttaannaaagcagctgtacgcccggatttcggatgcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgca

SEQ ID NO: 302430 - DNA, 1060 bp, Homo sapiens
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgca

SEQ ID NO: 302431 - DNA, 1066 bp, Homo sapiens
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgca

SEQ ID NO: 302432 - DNA, 761 bp, Homo sapiens
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaattaatttcctttcctctttagactcgagcaagcttttgctgcgggcgaattcgagcttattgggccatcgccctttgggggcggattacaatcaatgcgggggtttacaacgggggactgggaaacccggcggtcccaattaattgcttgagggaaatcccttttccagtggggggaaaa

SEQ ID NO: 302433 - DNA, 562 bp, Homo sapiens
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcacaggctgcggccgttaaggaggccccagggcctggagggcatctgtctgccaacaccctcccccgtgggcctaggcctctgtcctctccgaggcaggcaagcagggctggggagagggcctctgggcctgctgctccatggccaacaaggggtccgcacagctctgg

SEQ ID NO: 302434 - DNA, 718 bp, Homo sapiens
tctagaggatcctgcgtaatatgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgcatttccccattcttttttttttccctgtctccgtgacaaccagtggttcttcatttttgatcatgcgaaatgcattttgacccagatggtctgcagaacttcacttaggacattagcacacaaatagcacacatatcacatacccatttatatacataattagaaaatgttcctgatacatgtgtcatgtgatttcttccaacaaatgttttggaaaacagcaagcaactagtctgtaggttgtcttttctctagagatccttgtcctgggacagcctggggcaagttattaagcatatttccttcctggtgggctagatgatgtgcattatacctgtagtaccttcatactagcccttacaagttaaatgtcctgtggccatcttagccgaaagtctttggttgcaaaatcttataggtaaaaacagttgaaagaacattatgggatttccttgcttgttctgatacaatacaactagatgaccttaaaaaccctcata

SEQ ID NO: 302435 - DNA, 420 bp, Homo sapiens
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcgcattgggatcccgtggcagtcgcgagcaacatgaaagtgagcagatagagttgacgcacatgtgaggacgactgatacactcggaccagatatatttttcgggaggaggaa

SEQ ID NO: 302436 - DNA, 534 bp, Homo sapiens
cgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagtgagtttcagggtggggctgcccggcgtggcgcgagtcgaagaaagaccgctgggcctcaggtggtgggtagattaggcccgaaaaactgcggggtgcgggcgtgcgtatagtcgcggaaggttgtgtgtttcgaagctttgaggagctgaggctctggaaggcttgcggatcgcctggaagccacgatgtgagatggaaagaaccggaggctgaagcaggccaaagaagaagctcaggctgaaattgaacagtaccgcctgcagagggagaaagaattcaaggccaaggaagctgcggtggggcaccatttgtttttgttactg

SEQ ID NO: 302437 - DNA, 787 bp, Homo sapiens
ctgtctcataggcaattttattttcagaaaatggtagaatgagagaacagccagaaagacggaagaactgagggtaagaggtcctaaaagtgaagtgtgaagaaggttcacaaagtcataaagactgtattagggatcaaagttggtccctagatactggagatttgatgtcctagctaattgctccaccaacaggactgtctctcttatgagcactgtttcgtatgtatctttcagattctctgagactgaggagagatgtcttaccagcagcagcagtgcaagcagccctgccagccacctcctgtgtgccccacgccaaagtgcccagagccatgtccacccccgaagtgccctgagccttacctgcctcctccttgtccacctgagcattgcccacctccaccatgccaggataaatgccctcctgtgcaaccatacccaccctgccagcagaagtatccacccaagagcaagtaacatcactagaattcatcaggaccatgaaacaacaagatccagtggctcttcttattcccaggactccatcatcttcccttcagctgtagtgggaggctgcatcttccctaacctctgtctggcttgagcgttgacagagaaaaggcttagttctgaaaaccgatatgttgttggaagatgagcagccagatcattgcctaatctcgctttgctgtctgtgatgtagatggtggttcctatcctgagagcaagtgtgtttattcttttgcttctccccaataaagcacatgtttcatggtcaagccca

SEQ ID NO: 302438 - DNA, 1260 bp, Homo sapiens
agtaaaagaagtgagtttaaattagcaaaattcttgcccacattcaggaaaaaaaaataaatttgcagttagtttggcttggctcatgtgactctctaggcaaggaaaaccaggaaaatgatttgtctgctgaactgacagtcttgggtttgatacctattttatattctagtaattagttaaaatacagggttttatatccttgtaagtgtcaccatatgtaggagattaggactaaaggagacttgttcagagaattaaatttgaaaaactatacttcctttactaaaggttttgaaagcaaaacttgttttttcttcccaagtgttcagtgttcaggaatctggtgaatacttgctcagaaatttaacatcttcaattttaatttccctacctagcctttcttttttatttgttgttattgttttgccttctgtgatcagctcagggatgtgggcagtgggaacaaccttagaagccttaattcaggcctgatttccatgggagcatattgtccaggtgtacgcagaagaaggtgagcagacattcacactaaagctctgctaacattaattacttactaaattatgttttggattttagatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggtagtttatcatattaaatatgtcttaacttactacttgaaacaaaggggagttttcagagaatgttgaattttcaaagtataggagaaagtgatgcctgtataatatcctaatttatgctacttgagttaggcaagactcataagcataatgtaaaagccacaatagatgaaggagctttttattttgaaacgcatacagggaaatatcctgattcctgacatttgaatggaccaaatgaaataaataattttatgagaaaaagtggtaattctgaaacccaaagggaaatttaatttttccacaaaagttaataaatgttatatatttattaacttttttcccctccaaaatagggtacttagaatcaaaagaggaaaactgtgtcttgctctctcttctgtagtgagataaagaggagagaaatcctcatcaagagtggcaggtaaaaggaaaagaaagcctgcctttat

SEQ ID NO: 302439 - DNA, 3410 bp, Homo sapiens
gaattcgaggatccgggtaccatgggcggcggcaggcctagcagcacgggaaccgtcccccgcgcgcatgcgcgcgcccctgaagcgcctgggggacgggtatgggcgggaggtaggggcgcggctccgcgtgccagttgggtgcccgcgcgtcacgtggtgaggaaggaggcggaggtctgagtttcgagggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttaccccatggtacccggatcctcgaattc

SEQ ID NO: 302440 - DNA, 2040 bp, Homo sapiens
  misc_feature (1291)..(1291): n is a, c, g, or t
  misc_feature (2040)..(2040): n is a, c, g, or t
gcaattagcattatttgagcatttggcagcacaacccacatttatttcctcatggaagagacaagttagaagttttccttgttgaaaatgaaatgcactccccgagggccagactcagagttggagatgctttgtttactcagggtttcagccaaggcttcaggtccacagaggaaaactcctattctggtacttttgggaaagaaaaaaaaagacaatttcaagctttgggatgagatgtctacaaagcaggtaggtgaatttcccgttaatttgaggccccagggcagagtcccctctgctcctttttcttttccacaaatagcaaagggatcatattgcccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggtaagtatgttttttatttacaaagaaaacttaaagtggtttgatcttaattttacttggccagaagtcatcaaagttacgagaaaacaacttaactatttatattagaattactttatatgaagatttttaaagttctaatatttctggttattatttccttctgaagtgatcagaatcatgtgtatcattcatagattgcttagtaggtgatgggagtcattctgttttaccgtgctccttagttcatctcctggatgggttacttcttttggtgcatattattagggcattttcatgggacttaaaaaacatttttttttgttgtttttcaagacaacttatttgcccaaatcgtggactaattggtgatttttcctgatctttcagnataatctctgggtctttatcttgtttgtaataggaaatgttgaacagaataagatcagatacacagccttttgtagatctactaatgattatggatgttcatccagcagtaatccactgaacgcttatttttaagcccacatatctccaagttgtacaaacacagaattacctgatgttttcttaaaagattgtcaagattgactatctcaacttaagtgttcatgctttaaaagtgataacattaaaatatctataggaagcttgcaaatgatatatttgagaatgtgctataattgaactgaatgtagtttgctttggaaattgacttataactcacattcccctttctcaaattagtgtgtatgtgtgtgtgtgtgtatgtatgtatgtgtgtgttcagaactatggatgccttaaagcacaaaagatgttgtttgtgtgggatgtcagccttttttgtactcttctaataacattctagagtaaaaattttatagttaaccccagcatttaaaatgatgtttaccgttcctaggacacattaggatatgtggtttttagatatgtaatgatcatggagtagaaggattgttgaaattggatttaggagatctacctaggtttcaaaccaaatacttgagcagttgacttaacttaggtttccttaaaacatgttactctttttttaaattcctgtgcttgttgcgtggtaagttctagtaaatacctgtcaaactgaagttgtcn

SEQ ID NO: 302441 - DNA, 5810 bp, Homo sapiens
  misc_feature (1012)..(1012): n is a, c, g, or t
gaattcgaggatccgggtaccatgggcggcggcaggcctagcagcacgggaaccgtcccccgcgcgcatgcgcgcgcccctgaagcgcctgggggacgggtatgggcgggaggtaggggcgcggctccgcgtgccagttgggtgcccgcgcgtcacgtggtgaggaaggaggcggaggtctgagtttcgagggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattagtgaaggcttaaactgaggcttagaaaacttatgtcacttgattgtggacctcctgttntttaccctgtgctcttctgcttcactcatggaagaaagctgtaaattctcactgcctttacttcaaggatttctggggcttttctgaaatctactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttcaaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaattctttttttagtcaaggttagctataagtaatacttgttaaatgagtaaatatgtaatactttgtgaattactttgttaatttaggagcatcaaatgtatattatgtttagttatttatgaaactctcaatattgattgatttgggtaattataaattagttatttttacttgtaattgaatgcttaaattctgtttacagtccgtcctctctccctccatccctccctccccagttttataaattcaggtaccaattcacaaacaaaatcagaaataaaataaatttattgactgcttctggattta

SEQ ID NO: 302442 - DNA, 5019 bp, Homo sapiens
  misc_feature (1012)..(1012): n is a, c, g, or t
gaattcgaggatccgggtaccatgggcggcggcaggcctagcagcacgggaaccgtcccccgcgcgcatgcgcgcgcccctgaagcgcctgggggacgggtatgggcgggaggtaggggcgcggctccgcgtgccagttgggtgcccgcgcgtcacgtggtgaggaaggaggcggaggtctgagtttcgagggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattagtgaaggcttaaactgaggcttagaaaacttatgtcacttgattgtggacctcctgttntttaccctgtgctcttctgcttcactcatggaagaaagctgtaaattctcactgcctttacttcaaggatttctggggcttttctgaaatctactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatca

SEQ ID NO: 302443 - DNA, 6840 bp, Homo sapiens
  misc_feature (3402)..(3402): n is a, c, g, or t
gaattcgaggatccgggtaccatgggcggcggcaggcctagcagcacgggaaccgtcccccgcgcgcatgcgcgcgcccctgaagcgcctgggggacgggtatgggcgggaggtaggggcgcggctccgcgtgccagttgggtgcccgcgcgtcacgtggtgaggaaggaggcggaggtctgagtttcgagggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatggggtaagcatttaactatatgttttaaaatttaattttagaaaacttgtttttcagaagaattattgatgcttaaagctacatagttaaagtaattaatcttggtctctgtttaagtaatattccctcacaaaaccatgaatatattatgtggcattcaattagctactaatttgtctttcatctttccatgtacatgtggttgatattctctagagaaacatagttgtacaactcggcatgtgatttgtctataatatttaagttttataaaataatatttcagtagcctaaataaaagaactctttggtcatcttctctgaatatcaaaccttcaaagcttttgtggctgaatatcactttgctctacaggaaaaaaatttaatttttctttctttatagaagagccgtaataaccaacataaaatcgatcctcatctaatctcttgctctgcttttatttcatttttttaagttgccattgctttaaaagatttactatctttcttggatttactgtttttcaaattttttcaaatgtatttatgtaattcagttttgatactcatctctgtttgtttttcactttcatttccatttaaatattttgacattggaagctcatacttgcctgtctgttactataaaaaataggtttgactgtatagggattaaacaatttgtcttttatttttcttctagcaatgtgcaggttctatctgtgagaaatatggcttagaggagtgtacgtgtgccagttctgatggcaaagatgataaagaattatgccatgtatgctgtatgaagaaaagtaaggcttttaaaaacacaagagtataaaatttgcctcaaactattattttctcctaaattttaagtgtaaaactttgacctacagtttggccagataatttccagctaaatctgtcctcttgaggagattataaatgtaacgtagcattgtgtctctattattatggtctctacaatgttttaaaaatgataaactagacaaaacgttgccagctttacagcagtaatttacataaacactgttagactttaagtcatcgtggacactgagtcaagacttgctggttgcttgtttacattgtaacatttaatatgaattactgatggcgttacccagcctaactagagaaggtctgtataacatgttatggtaatgatttcagttttttttccctctttgtatttgcacaactggaaatctgatctncaacttatatttgaatctgaccttcagcttatatttggcatttcttttccagtggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttcaaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaattctttttttagtcaaggttagctataagtaatacttgttaaatgagtaaatatgtaatactttgtgaattactttgttaatttaggagcatcaaatgtatattatgtttagttatttatgaaactctcaatattgattgatttgggtaattataaattagttatttttacttgtaattgaatgcttaaattctgtttacagtccgtcctctctccctccatccctccctccccagttttataaattcaggtaccaattcacaaacaaaatcagaaataaaataaatttattgactgcttctggattta

SEQ ID NO: 302444 - DNA, 5794 bp, Homo sapiens
  misc_feature (1012)..(1012): n is a, c, g, or t
gaattcgaggatccgggtaccatgggcggcggcaggcctagcagcacgggaaccgtcccccgcgcgcatgcgcgcgcccctgaagcgcctgggggacgggtatgggcgggaggtaggggcgcggctccgcgtgccagttgggtgcccgcgcgtcacgtggtgaggaaggaggcggaggtctgagtttcgagggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattagtgaaggcttaaactgaggcttagaaaacttatgtcacttgattgtggacctcctgttntttaccctgtgctcttctgcttcactcatggaagaaagctgtaaattctcactgcctttacttcaaggatttctggggcttttctgaaatctactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttcaaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaattctttttttagtcaaggttagctataagtaatacttgttaaatgagtaaatatgtaatactttgtgaattactttgttaatttaggagcatcaaatgtatattatgtttagttatttatgaaactctcaatattgattgatttgggtaattataaattagttatttttacttgtaattgaatgcttaaattctgtttacagtccgtcctctctccctccatccctccctccccagttttataaattcaggtaccaattcacaaacaaaatcagaaataaaataaatttattgactgcttctggattta

SEQ ID NO: 302445 - DNA, 6146 bp, Homo sapiens
  misc_feature (2708)..(2708): n is a, c, g, or t
agtaaaagaagtgagtttaaattagcaaaattcttgcccacattcaggaaaaaaaaataaatttgcagttagtttggcttggctcatgtgactctctaggcaaggaaaaccaggaaaatgatttgtctgctgaactgacagtcttgggtttgatacctattttatattctagtaattagttaaaatacagggttttatatccttgtaagtgtcaccatatgtaggagattaggactaaaggagacttgttcagagaattaaatttgaaaaactatacttcctttactaaaggttttgaaagcaaaacttgttttttcttcccaagtgttcagtgttcaggaatctggtgaatacttgctcagaaatttaacatcttcaattttaatttccctacctagcctttcttttttatttgttgttattgttttgccttctgtgatcagctcagggatgtgggcagtgggaacaaccttagaagccttaattcaggcctgatttccatgggagcatattgtccaggtgtacgcagaagaaggtgagcagacattcacactaaagctctgctaacattaattacttactaaattatgttttggattttagatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatggggtaagcatttaactatatgttttaaaatttaattttagaaaacttgtttttcagaagaattattgatgcttaaagctacatagttaaagtaattaatcttggtctctgtttaagtaatattccctcacaaaaccatgaatatattatgtggcattcaattagctactaatttgtctttcatctttccatgtacatgtggttgatattctctagagaaacatagttgtacaactcggcatgtgatttgtctataatatttaagttttataaaataatatttcagtagcctaaataaaagaactctttggtcatcttctctgaatatcaaaccttcaaagcttttgtggctgaatatcactttgctctacaggaaaaaaatttaatttttctttctttatagaagagccgtaataaccaacataaaatcgatcctcatctaatctcttgctctgcttttatttcatttttttaagttgccattgctttaaaagatttactatctttcttggatttactgtttttcaaattttttcaaatgtatttatgtaattcagttttgatactcatctctgtttgtttttcactttcatttccatttaaatattttgacattggaagctcatacttgcctgtctgttactataaaaaataggtttgactgtatagggattaaacaatttgtcttttatttttcttctagcaatgtgcaggttctatctgtgagaaatatggcttagaggagtgtacgtgtgccagttctgatggcaaagatgataaagaattatgccatgtatgctgtatgaagaaaagtaaggcttttaaaaacacaagagtataaaatttgcctcaaactattattttctcctaaattttaagtgtaaaactttgacctacagtttggccagataatttccagctaaatctgtcctcttgaggagattataaatgtaacgtagcattgtgtctctattattatggtctctacaatgttttaaaaatgataaactagacaaaacgttgccagctttacagcagtaatttacataaacactgttagactttaagtcatcgtggacactgagtcaagacttgctggttgcttgtttacattgtaacatttaatatgaattactgatggcgttacccagcctaactagagaaggtctgtataacatgttatggtaatgatttcagttttttttccctctttgtatttgcacaactggaaatctgatctncaacttatatttgaatctgaccttcagcttatatttggcatttcttttccagtggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttcaaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaattctttttttagtcaaggttagctataagtaatacttgttaaatgagtaaatatgtaatactttgtgaattactttgttaatttaggagcatcaaatgtatattatgtttagttatttatgaaactctcaatattgattgatttgggtaattataaattagttatttttacttgtaattgaatgcttaaattctgtttacagtccgtcctctctccctccatccctccctccccagttttataaattcaggtaccaattcacaaacaaaatcagaaataaaataaatttattgactgcttctggattta

SEQ ID NO: 302446 - DNA, 3203 bp, Homo sapiens
ttttttttttttcagtggaaaaatctgtttatttctaggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttcaaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaattctttttttagtcaaggttagctataagtaatacttgttaaatgagtaaatatgtaatactttgtgaattactttgttaatttaggagcatcaaatgtatattatgtttagttatttatgaaactctcaatattgattgatttgggtaattataaattagttatttttacttgtaattgaatgcttaaattctgtttacagtccgtcctctctccctccatccctccctccccagttttataaattcaggtaccaattcacaaacaaaatcagaaataaaataaatttattgactgcttctggattta

SEQ ID NO: 302447 - DNA, 5532 bp, Homo sapiens
gaattcgaggatccgggtaccatgggcggcggcaggcctagcagcacgggaaccgtcccccgcgcgcatgcgcgcgcccctgaagcgcctgggggacgggtatgggcgggaggtaggggcgcggctccgcgtgccagttgggtgcccgcgcgtcacgtggtgaggaaggaggcggaggtctgagtttcgagggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttcaaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaattctttttttagtcaaggttagctataagtaatacttgttaaatgagtaaatatgtaatactttgtgaattactttgttaatttaggagcatcaaatgtatattatgtttagttatttatgaaactctcaatattgattgatttgggtaattataaattagttatttttacttgtaattgaatgcttaaattctgtttacagtccgtcctctctccctccatccctccctccccagttttataaattcaggtaccaattcacaaacaaaatcagaaataaaataaatttattgactgcttctggattta

SEQ ID NO: 302448 - DNA, 3538 bp, Homo sapiens
gaattcgaggatccgggtaccatgggcggcggcaggcctagcagcacgggaaccgtcccccgcgcgcatgcgcgcgcccctgaagcgcctgggggacgggtatgggcgggaggtaggggcgcggctccgcgtgccagttgggtgcccgcgcgtcacgtggtgaggaaggaggcggaggtctgagtttcgagggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggagaccgagattttgatgatggcgtacttggtctggcttgggttggagcaccttcaggaagctctggaggaatatgtgaaaaaagtaaactctattcagatgtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttcaaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaattctttttttagtcaaggttagctataagtaatacttgttaaatgagtaaatatgtaatactttgtgaattactttgttaatttaggagcatcaaatgtatattatgtttagttatttatgaaactctcaatattgattgatttgggtaattataaattagttatttttacttgtaattgaatgcttaaattctgtttacagtccgtcctctctccctccatccctccctccccagttttataaattcaggtaccaattcacaaacaaaatcagaaataaaataaatttattgactgcttctggattta

SEQ ID NO: 302449 - DNA, 1567 bp, Homo sapiens
tcacggcactccagactgggcgaaagagtaagactctgtctcaaaaataaataaaggaaattacaaaaattagccgggcatggtagcacatgcctgtaatcccagatgcctgtttcgctgcagcggaaccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttcaaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaattctttttttagtcaaggttagctataagtaatacttgttaaatgagtaaatatgtaatactttgtgaattactttgttaatttaggagcatcaaatgtatattatgtttagttatttatgaaactctcaatattgattgatttgggtaattataaattagttatttttacttgtaattgaatgcttaaattctgtttacagtccgtcctctctccctccatccctccctccccagttttataaattcaggtaccaattcacaaacaaaatcagaaataaaataaatttattgactgcttctggattta

SEQ ID NO: 302450 - DNA, 1222 bp, Homo sapiens
gaattcgaggatccgggtaccatgggcggcggcaggcctagcagcacgggaaccgtcccccgcgcgcatgcgcgcgcccctgaagcgcctgggggacgggtatgggcgggaggtaggggcgcggctccgcgtgccagttgggtgcccgcgcgtcacgtggtgaggaaggaggcggaggtctgagtttcgagggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagacactcttgcttgctcctgcttccagcatgtcatgtgcctgctcccccttcaccttctgcccatgcttataagcttcctgagacctctctagaagccaagcggatgccagcaccatgcttcctgtaaagcctgcagaacgatgagccaattaaaactcttttcttgat

SEQ ID NO: 302451 - DNA, 1954 bp, Homo sapiens
gaattcgaggatccgggtaccatgggcggcggcaggcctagcagcacgggaaccgtcccccgcgcgcatgcgcgcgcccctgaagcgcctgggggacgggtatgggcgggaggtaggggcgcggctccgcgtgccagttgggtgcccgcgcgtcacgtggtgaggaaggaggcggaggtctgagtttcgagggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggtagtttatcatattaaatatgtcttaacttactacttgaaacaaaggggagttttcagagaatgttgaattttcaaagtataggagaaagtgatgcctgtataatatcctaatttatgctacttgagttaggcaagactcataagcataatgtaaaagccacaatagatgaaggagctttttattttgaaacgcatacagggaaatatcctgattcctgacatttgaatggaccaaatgaaataaataattttatgagaaaaagtggtaattctgaaacccaaagggaaatttaatttttccacaaaagttaataaatgttatatatttattaacttttttcccctccaaaatagggtacttagaatcaaaagaggaaaactgtgtcttgctctctcttctgtagtgagataaagaggagagaaatcctcatcaagagtggcaggtaaaaggaaaagaaagcctgcctttat

SEQ ID NO: 302452 - DNA, 1614 bp, Homo sapiens
gaattcgaggatccgggtaccatgggcggcggcaggcctagcagcacgggaaccgtcccccgcgcgcatgcgcgcgcccctgaagcgcctgggggacgggtatgggcgggaggtaggggcgcggctccgcgtgccagttgggtgcccgcgcgtcacgtggtgaggaaggaggcggaggtctgagtttcgagggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggagcccctgcccggtggcggattccgaagtcctctccgccgccgagacccgccgcgcagactcgtgggaagttgtgttgtttgcagctgggctcgtgtattgttctttacccggcgcgccggtcctgaccgaccccattctgcagaggggccgcccgtggagtggcagcagtcatcacccgcttatctgagactagtggcctcggttcttcctgtgtcctgtgtttggagagagatcacaggagggtgtgttggtgttcttgaaaacattctgtcgcccaggggaaagggtttggtcgggagaagggtaaaccatttggggatgttctttgatttgtaggctggattgggtctcttagagtagaagttcggtccctgggtgacccaacttgaagagtttcgttaaactttcaggtggagtagatgtacagtgtagttagtggattgtcaaaacagtgccccctcccccctgcacatgaaagtcaaatttgctaaaagcatgtcatttcttgtttcgggttttgaagacaacgatttttatttccggtgtgttctaggaccagctgcatcattttattcttgcttaaagtgctttattttaggtaagctttttgacttgccccagagtaaacttaaaaacctcaaggtgtgcctaaaagcaacgattgaaaaaatttgaggaatgctttggatgagtgtctgtagcctttgataatttagaaaatatctatttcatgtaatgtattgtttctgtttttttctttgccactttgacttatgactgcaggaccaagtgtatttctgtcctgtattctaccgagtccgagggtggtactgcgtaggcagacttctgttatagtttgtagtgttcatttttttgttacacgttttatttaatttttttcaatccaattcatcaagcaagacacacattatagattaagagctgataatagatgtttagttttaaaaaggattatgtgcgggagactctctgttagaggagcctttttcatctgacatttgttatttctgttctaaacgtggctttcaacaaatcgttttcctatcttttttcactttttgtgattaaa

SEQ ID NO: 302453 - DNA, 2493 bp, Homo sapiens
tgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatatttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaaaaaaaaaaaaaaaaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtaggcagagacccggccgccgcccccgccctctggcgcaggcggggtacggcgccgcctctgagcgccatcgtctcacaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaagggggcctagggtggtctgggaggcgtctccaaggaggtgacacttaagccatccccgaaagaggtgaaagagatcactttggggagagctggagaacaggattctaggcggaagcgatagcataggcaaaggcccttgggcaggaaggcgctcagccttggctggagtagaattaagtcagagccaacaggttggggagagacagagaagtgggcaggggcacccaagttgggatttcatttcaggtgcattggagattcttaggagtgtctcttgggggtaatattttattttttaaaaaatgaggat

SEQ ID NO: 302454 - DNA, 2412 bp, Homo sapiens
tgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatatttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaaaaaaaaaaaaaaaaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaagggggcctagggtggtctgggaggcgtctccaaggaggtgacacttaagccatccccgaaagaggtgaaagagatcactttggggagagctggagaacaggattctaggcggaagcgatagcataggcaaaggcccttgggcaggaaggcgctcagccttggctggagtagaattaagtcagagccaacaggttggggagagacagagaagtgggcaggggcacccaagttgggatttcatttcaggtgcattggagattcttaggagtgtctcttgggggtaatattttattttttaaaaaatgaggat

SEQ ID NO: 302455 - DNA, 700 bp, Homo sapiens
gagtgtcatggaaaaagaccatgcggcaaaaagtggcagaggtaagatggagccagggtttgctgtcatccacagtgaatgccgtcctccacggcatggtctctgtctcacagagagggattgtctggggagactgctaacacttcagtccctttttatgagcattgattttatacattttgatatgaactttcattaagtttgcatgtttttccataggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaaggtatggaacaacaacgagaaccgaaacccaaatctaaatacacttcttacatgtaaaatgtatttaagtataaatctccctaactggttccaagcttgtacgagtggaataattttttggtggaatgttggtttctggttagtagtggaacacttgttgtttttgaaaacagaggtaaggacacagacggaaccaccagtgggttcgccttttctgctgcccagacagagccgatttatcaagacgggaattgcaatggagaaagagtaat

SEQ ID NO: 302456 - DNA, 1048 bp, Homo sapiens
attaggcgttagagacctactcgatgtttcagggatagatagattaggcgtttagttcgacacacttcatgtttaaaaagcctcttctaggccgggtgcggtggctcatgcctgtaaagccagcactttgggaggctgaggcgggcggatcacgaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaaggtatggaacaacaacgagaaccgaaacccaaatctaaatacacttcttacatgtaaaatgtatttaagtataaatctccctaactggttccaagcttgtacgagtggaataattttttggtggaatgttggtttctggttagtagtggaacacttgttgtttttgaaaacagaggtaaggacacagacggaaccaccagtgggttcgccttttctgctgcccagacagagccgatttatcaagacgggaattgcaatggagaaagagtaat

SEQ ID NO: 302457 - DNA, 11543 bp, Homo sapiens
ccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaaaattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctcacatgtgtctagatcctgggattccagaaaatggtagaagagcaggttccgacttcagtagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcaatttgactttctcgcggtcaaggataatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaatgacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataatacccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctatggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcaagatccaagtgatcagttttgccacggagcagaactgggacttccctttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgaaggcttcaagcttgaatccagccagcaagcaacagccgtgtgtcaagaagatgggctgtggagtaacaaggggaagccgcccatgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggatttcacttgctgggatcttcagccttgacctgtatggcaaatggcttatgggaccgatccctgcccaagtgtttggctatatcctgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccgcgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaagaagacacctttctgatagaggctcacacctacaaatgcttcactctgtccttccgagacctgacaagctttgaggacctcacagctcccctgtgtgttcatctctagggatgtttgcaatttcccagtcagctgttctgtcgcagaatgtttaatgcacaattttttgcactagtgtgttatgaatgactaagattctgataaaaaaataaattatttacacagggtttatacacactatccattg

SEQ ID NO: 302458 - DNA, 11186 bp, Homo sapiens
ccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaaaattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctcacatgtgtctagatcctgggattccagaaaatggtagaagagcaggttccgacttcagtagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcaatttgactttctcgcggtcaaggataatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaatgacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataatacccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctatggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcaagatccaagtgatcagttttgccacggagcagaactgggacttccctttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgaaggcttcaagcttgaatccagccagcaagcaacagccgtgtgtcaagaagatgggctgtggagtaacaaggggaagccgcccatgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggatttcacttgctgggatcttcagccttgacctgtatggcaaatggcttatgggaccgatccctgcccaagtgtttggctatatcctgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccgcgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaagaagacacctttctgatagaggctcacacctacaaatgcttcactctgtccttccgagacctgacaagctttgaggacctcacagctcccctgtgtgttcatctctagggatgtttgcaatttcccagtcagctgttctgtcgcagaatgtttaatgcacaattttttgcactagtgtgttatgaatgactaagattctgataaaaaaataaattatttacacagggtttatacacactatccattg

SEQ ID NO: 302459 - DNA, 620 bp, Homo sapiens
gagtgtcatggaaaaagaccatgcggcaaaaagtggcagaggtaagatggagccagggtttgctgtcatccacagtgaatgccgtcctccacggcatggtctctgtctcacagagagggattgtctggggagactgctaacacttcagtccctttttatgagcattgattttatacattttgatatgaactttcattaagtttgcatgtttttccataggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaaggaggatctggaaacattggtcctgctttcccatgtcttgacaccccattccaagccagatgtcaaggagaagaaaggactttcaattaaaaaaaaaacaaaaactcgaaacaacatgttttttattgtacgccattaatttcctatcactgagatataaaaataaataatacaaataaatgagaacatgaa

SEQ ID NO: 302460 - DNA, 6472 bp, Homo sapiens
ccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaaaattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctcacatgtgtctagatcctgggattccagaaaatggtagaagagcaggttccgacttcagtagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcaatttgactttctcgcggtcaaggataatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaatgacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataatacccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctatggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcaagatccaagtgatcagttttgccacggagcagaactgggacttccctttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtaagtgaaaatgttaccaattcctaaaagttcatttttttcatttccatcttggaaagaattaagcagaataaaatgccttattctgttggcataactgtatctgtaattgaaagtggcgtacagatttaaataaagctttggcagagt

SEQ ID NO: 302461 - DNA, 6803 bp, Homo sapiens
ccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaaaattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctcacatgtgtctagatcctgggattccagaaaatggtagaagagcaggttccgacttcagtagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcaatttgactttctcgcggtcaaggataatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaatgacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataatacccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctatggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcaagatccaagtgatcagttttgccacggagcagaactgggacttccctttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaaggtatggaacaacaacgagaaccgaaacccaaatctaaatacacttcttacatgtaaaatgtatttaagtataaatctccctaactggttccaagcttgtacgagtggaataattttttggtggaatgttggtttctggttagtagtggaacacttgttgtttttgaaaacagaggtaaggacacagacggaaccaccagtgggttcgccttttctgctgcccagacagagccgatttatcaagacgggaattgcaatggagaaagagtaat

SEQ ID NO: 302462 - DNA, 5440 bp, Homo sapiens
gagtgtcatggaaaaagaccatgcggcaaaaagtggcagaggtaagatggagccagggtttgctgtcatccacagtgaatgccgtcctccacggcatggtctctgtctcacagagagggattgtctggggagactgctaacacttcagtccctttttatgagcattgattttatacattttgatatgaactttcattaagtttgcatgtttttccataggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgaaggcttcaagcttgaatccagccagcaagcaacagccgtgtgtcaagaagatgggctgtggagtaacaaggggaagccgcccatgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggatttcacttgctgggatcttcagccttgacctgtatggcaaatggcttatgggaccgatccctgcccaagtgtttggctatatcctgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccgcgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaagaagacacctttctgatagaggctcacacctacaaatgcttcactctgtccttccgagacctgacaagctttgaggacctcacagctcccctgtgtgttcatctctagggatgtttgcaatttcccagtcagctgttctgtcgcagaatgtttaatgcacaattttttgcactagtgtgttatgaatgactaagattctgataaaaaaataaattatttacacagggtttatacacactatccattg

SEQ ID NO: 302463 - DNA, 5788 bp, Homo sapiens
attaggcgttagagacctactcgatgtttcagggatagatagattaggcgtttagttcgacacacttcatgtttaaaaagcctcttctaggccgggtgcggtggctcatgcctgtaaagccagcactttgggaggctgaggcgggcggatcacgaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgaaggcttcaagcttgaatccagccagcaagcaacagccgtgtgtcaagaagatgggctgtggagtaacaaggggaagccgcccatgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggatttcacttgctgggatcttcagccttgacctgtatggcaaatggcttatgggaccgatccctgcccaagtgtttggctatatcctgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccgcgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaagaagacacctttctgatagaggctcacacctacaaatgcttcactctgtccttccgagacctgacaagctttgaggacctcacagctcccctgtgtgttcatctctagggatgtttgcaatttcccagtcagctgttctgtcgcagaatgtttaatgcacaattttttgcactagtgtgttatgaatgactaagattctgataaaaaaataaattatttacacagggtttatacacactatccattg

SEQ ID NO: 302464 - DNA, 7555 bp, Homo sapiens
ccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaaaattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctcacatgtgtctagatcctgggattccagaaaatggtagaagagcaggttccgacttcagtagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcaatttgactttctcgcggtcaaggataatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaatgacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataatacccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctatggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcaagatccaagtgatcagttttgccacggagcagaactgggacttccctttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggtaagtttctttaatctttgtagagcagtgacctcggcatcattgataaaaacactattacaatgttttagtaacataaagactggaatatattcttgagttaacttatgttttcccaaagcaaac

SEQ ID NO: 302465 - DNA, 1546 bp, Homo sapiens
ccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaaaattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtctggcatcagcaagagttcagcaagtgcaggaagaaaaagagagagatcatgacaaggaatgggagaatttccctgacagcctcaggaaacttgcagtttgataattaaacagatcaagctcactcagatgagctgatgggacatgctgtgtacggaggagcatttgcagttacaacactttgtagccatgcaggatggggcaattaatccagaaccattatttaataaaaagatgattttttaaatgtggaaa

SEQ ID NO: 302466 - DNA, 405 bp, Homo sapiens
aatttctctgattctttccttttccctgtttattagttataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaaggtttgtttggtgactctttggattttacagatgtgtatagaagtctttattgaattatgctttgtttaattttgcaagcatttatgtagcccttctaggggctaggaattcttgaacagcaatttgcaactattaagtcactttatttttataatactttaatctcagttttacagatggaaaaactaa

SEQ ID NO: 302467 - DNA, 281 bp, Homo sapiens
tgctttttcctttcattgacttgtttatacagggatagaaactatcctattgcagttggaatcattttattaaagcaaacttttgctggtacttttctctccagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactgg

SEQ ID NO: 302468 - DNA, 1810 bp, Homo sapiens
agcggaaacgcagttccggttaggcggctgagtttgtttacgttgctaacagatctagcccctgctttccctagttccagttccaagatggggaaatccttcgccaacttcatgtgcaagaaagactttcatcctgcctccaaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccaccaggagctaaaaaagaaaacaaagagaaagaagaaacagaaggagagaccgaatacaaatttgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcagatgctgtgttacaaattgaaggtttctgggccatcgatgcacccctcggagctaatagcggagatgagaaacagtgggtttgcactgaaacgaaatgtactggggagaaacttgaccgcaaatgatccatcacaggagtatgttgcaagtgagggtgaagaagatccagaagttgaatttttaaagtcactaacaaccaaacaaaaacagaaacttctcaggaaattagatcgactggagaagaaaaaaaagaaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaagaaaaaaaaatacaaaggaagaaaagaaagaaaaacaagtgttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggacagcaaatggagccattctgattctgacaaaaagtccagaacccataaacatagcccagagaagagaggctctgaaagaaaggaggggagcagcagaagccacggcagggaggaaaggagccggagaagccggagcagaagtcctggtagttacaagcaaagggagacaaggaaacgggcacagcgaaatcctggtgaagagcaaagcagaagaaatgacagcagaagccatggcacagacttgtatagaggagaaaaaatgtacagagagcacccaggaggtacacatactaaagtgacacaaagagaatgaagcagaagtagagaagaaagactgtatgtgacaattacctgggaataaaaatatctccacttttttattgaatacctttagcaaggggtaaattatgtactgttgtctttctaataaaaaagctcaattttaatttttcatctctagactgtcaattcaagtacaaaactacatgagtactatgagaatgaattttgcaaatatttgtaagtaagctattttggggctgtggaaatattttctgttggtaactgtttcttgttccccataccagataaaaaccgcatataactctgtgacattttctttgttctgaaacatcattaaaagaatgacagtaca

SEQ ID NO: 302469 - DNA, 804 bp, Homo sapiens
agcggaaacgcagttccggttaggcggctgagtttgtttacgttgctaacagatctagcccctgctttccctagttccagttccaagatggggaaatccttcgccaacttcatgtgcaagaaagactttcatcctgcctccaaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccaccaggagctaaaaaagaaaacaaagagaaagaagaaacagaaggagagaccgaatacaaatttgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcaggtaggcactagacatgatttgtttcgggagaggacaaacaaggaaagataaaacaacatttttctttactctttctgggtattgtttaattgggtttgtgtgtggggcttgttgttgtttttgactaagaccattcccaaaatatgattaatgggaaactctgatcatatatgttgaattaaaatgctgtgtaataggattaagtttaatttttccagccaaaggccctatga

SEQ ID NO: 302470 - DNA, 1782 bp, Homo sapiens
agcggaaacgcagttccggttaggcggctgagtttgtttacgttgctaacagatctagcccctgctttccctagttccagttccaagatggggaaatccttcgccaacttcatgtgcaagaaagactttcatcctgcctccaaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccaccaggagctaaaaaagaaaacaaagagaaagaagaaacagaaggagagaccgaatacaaatttgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcagggccatcgatgcacccctcggagctaatagcggagatgagaaacagtgggtttgcactgaaacgaaatgtactggggagaaacttgaccgcaaatgatccatcacaggagtatgttgcaagtgagggtgaagaagatccagaagttgaatttttaaagtcactaacaaccaaacaaaaacagaaacttctcaggaaattagatcgactggagaagaaaaaaaagaaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaagaaaaaaaaatacaaaggaagaaaagaaagaaaaacaagtgttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggacagcaaatggagccattctgattctgacaaaaagtccagaacccataaacatagcccagagaagagaggctctgaaagaaaggaggggagcagcagaagccacggcagggaggaaaggagccggagaagccggagcagaagtcctggtagttacaagcaaagggagacaaggaaacgggcacagcgaaatcctggtgaagagcaaagcagaagaaatgacagcagaagccatggcacagacttgtatagaggagaaaaaatgtacagagagcacccaggaggtacacatactaaagtgacacaaagagaatgaagcagaagtagagaagaaagactgtatgtgacaattacctgggaataaaaatatctccacttttttattgaatacctttagcaaggggtaaattatgtactgttgtctttctaataaaaaagctcaattttaatttttcatctctagactgtcaattcaagtacaaaactacatgagtactatgagaatgaattttgcaaatatttgtaagtaagctattttggggctgtggaaatattttctgttggtaactgtttcttgttccccataccagataaaaaccgcatataactctgtgacattttctttgttctgaaacatcattaaaagaatgacagtaca

SEQ ID NO: 302471 - DNA, 1916 bp, Homo sapiens
agcggaaacgcagttccggttaggcggctgagtttgtttacgttgctaacagatctagcccctgctttccctagttccagttccaagatggggaaatccttcgccaacttcatgtgcaagaaagactttcatcctgcctccaaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccaccaggagctaaaaaagaaaacaaagagaaagaagaaacagaaggagagaccgaatacaaatttgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcagggccatcgatgcacccctcggagctaatagcggagatgagaaacagtgggtttgcactgaaacgaaatgtactggggagaaacttgaccgcaaatgatccatcacaggagtatgttgcaagtgagggtgaagaagatccagaagttgaatttttaaagtcactaacaaccaaacaaaaacagaaacttctcaggaaattagatcgactggagaagaaaaaaaagaaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaagaaaaaaaaatacaaaggaagaaaagaaagaaaaacaagtgttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggacagcaaatggagccattctgattctgacaaaaagtccagaacccataaacatagcccagagaagagaggctctgaaagaaaggaggggagcagcagaagccacggcagggaggaaaggagccggagaagccggagcagaagtcctggtagttacaagcaaagggagacaaggaaacgggcacagcgaaatcctggtgaagagcaaagcagaagaaatgacagcagaagccatggcacagacttgtatagaggagaaaaaatgtacagagagcacccaggaggtacacatactaaagtgacacaaagagaatgaagcagaagtagagaagaaagactgtatgtgacaattacctgggaataaaaatatctccacttttttattgaatacctttagcaaggggtaaattatgtactgttgtctttctaataaaaaagctcaattttaatttttcatctctagactgtcaattcaagtacaaaactacatgagtactatgagaatgaattttgcaaatatttgtaagtaagctattttggggctgtggaaatattttctgttggtaactgtttcttgttccccataccagataaaaaccgcatataactctgtgacattttctttgttctgaaacatcattaaaagaatgacagtacattgaatgggtataatttacttttttcaattcaaatttgttattctaggatttgaatttgcttgaagtgaattgtaataattattcaaattcattagtataaattaaggattaataaatctttaagacttttaag

SEQ ID NO: 302472 - DNA, 1980 bp, Homo sapiens
agcggaaacgcagttccggttaggcggctgagtttgtttacgttgctaacagatctagcccctgctttccctagttccagttccaagatggggaaatccttcgccaacttcatgtgcaagaaagactttcatcctgcctccaaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccaccaggagctaaaaaagaaaacaaagagaaagaagaaacagaaggagagaccgaatacaaatttgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcagggccatcgatgcacccctcggagctaatagcggagatgagaaacagtgggtttgcactgaaacgaaatgtactggggagaaacttgaccgcaaatgatccatcacaggagtatgttgcaagtgagggtgaagaagatccagaagttgaatttttaaagtcactaacaaccaaacaaaaacagaaacttctcaggaaattagatcgactggagaagaaaaaaaagaaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaagaaaaaaaaatacaaaggaagaaaagaaagaaaaacaagtgttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggacagcaaatggagccattctgattctgacaaaaagtccagaacccataaacatagcccagagaagagaggctctgaaagaaaggaggggagcagcagaagccacggcagggaggaaaggagccggagaagccggagcagaagtcctggtagttacaagcaaagggagacaaggaaacgggcacagcgaaatcctggtgaagagcaaagcagaagaaatgacagcagaagccatggcacagacttgtatagaggagaaaaaatgtacagagagcacccaggaggtacacatactaaagtgacacaaagagaatgaagcagaagtagagaagaaagactgtatgtgacaattacctgggaataaaaatatctccacttttttattgaatacctttagcaaggggtaaattatgtactgttgtctttctaataaaaaagctcaattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaggaacaaagaagaagaaaaatagactataaaggggaccgacaaatattggtaccaacagataaacattatctacttgtaacagcgccgggccctctaattagagcagggacggtaatataatattaaccacaagacactactactcaagtaaaataataatatacgagcagagttgtcaggacgtagctatgaggtgcagcagcgacattctcctacgaaaaaggatcatacttctatctgttgtggtccacgtaaaagctactgatgcaaaactcacagtacagagttacataactccgccatcagcgagtt

SEQ ID NO: 302473 - DNA, 1688 bp, Homo sapiens
ctactactactaaattcgcggccgcgtcgacctttcatcctgcctccaaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccaccaggagctaaaaaagaaaacaaagagaaagaagaaacagaaggagagaccgaatacaaatttgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcagggccatcgatgcacccctcggagctaatagcggagatgagaaacagtgggtttgcactgaaacgaaatgtactggggagaaacttgaccgcaaatgatccatcacaggagtatgttgcaagtgagggtgaagaagatccagaagttgaatttttaaagtcactaacaaccaaacaaaaacagaaacttctcaggaaattagatcgactggagaagaaaaaaaagaaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaagaaaaaaaaatacaaaggaagaaaagaaagaaaaacaagtgttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggacagcaaatggagccattctgattctgacaaaaagtccagaacccataaacatagcccagagaagagaggctctgaaagaaaggaggggagcagcagaagccacggcagggaggaaaggagccggagaagccggagcagaagtcctggtagttacaagcaaagggagacaaggaaacgggcacagcgaaatcctggtgaagagcaaagcagaagaaatgacagcagaagccatggcacagacttgtatagaggagaaaaaatgtacagagagcacccaggaggtacacatactaaagtgacacaaagagaatgaagcagaagtagagaagaaagactgtatgtgacaattacctgggaataaaaatatctccacttttttattgaatacctttagcaaggggtaaattatgtactgttgtctttctaataaaaaagctcaattttaatttttcatctctagactgtcaattcaagtacaaaactacatgagtactatgagaatgaattttgcaaatatttgtaagtaagctattttggggctgtggaaatattttctgttggtaactgtttcttgttccccataccagataaaaaccgcatataactctgtgacattttctttgttctgaaacatcattaaaagaatgacagtaca

SEQ ID NO: 302474 - DNA, 1419 bp, Homo sapiens
  misc_feature (1300)..(1300): n is a, c, g, or t
  misc_feature (1303)..(1303): n is a, c, g, or t
  misc_feature (1306)..(1306): n is a, c, g, or t
  misc_feature (1317)..(1317): n is a, c, g, or t
  misc_feature (1319)..(1320): n is a, c, g, or t
  misc_feature (1324)..(1328): n is a, c, g, or t
  misc_feature (1339)..(1339): n is a, c, g, or t
  misc_feature (1341)..(1341): n is a, c, g, or t
  misc_feature (1344)..(1344): n is a, c, g, or t
  misc_feature (1347)..(1349): n is a, c, g, or t
  misc_feature (1359)..(1359): n is a, c, g, or t
  misc_feature (1415)..(1415): n is a, c, g, or t
agcggaaacgcagttccggttaggcggctgagtttgtttacgttgctaacagatctagcccctgctttccctagttccagttccaagatggggaaatccttcgccaacttcatgtgcaagaaagactttcatcctgcctccaaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccaccaggagctaaaaaagaaaacaaagagaaagaagaaacagaaggagagaccgaatacaaatttgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcagggccatcgatgcacccctcggagctaatagcggagatgagaaacagtgggtttgcactgaaacgaaatgtactggggagaaacttgaccgcaaatgatccatcacaggagtatgttgcaagtgagggtgaagaagatccagaagttgaatttttaaagtcactaacaaccaaacaaaaacagaaacttctcaggaaattagatcgactggagaagaaaaaaaagaaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaagaaaaaaaaatacaaaggaagaaaagaaagaaaaacaagtgttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggacagcaaatggagccattctgattctgacaaaaagtccagaacccataaacatagcccagagaagagaggctctgaaagaaaggaggggagcagcagaagccacggcagggaggaaaggagccggagaagccggagcagaagtcctggtagttacaagcacccgccccacaagnacnccngcgcacagcgncnncctnnnnnctcgctacgcngncgntcnnnccgcatccanccatcgcactatgacttgtttcagaggatgaaaaatatgtacatagagcacccacnaggt

SEQ ID NO: 302475 - DNA, 1698 bp, Homo sapiens
  misc_feature (101)..(101): n is a, c, g, or t
  misc_feature (110)..(110): n is a, c, g, or t
aggagaaccagaaggttcagtaaaagaaatcaagcatagtcctggccccacgagaacagtctccactggcacggcattgtctaaatataggagcagatctncagatgggncccagaattacttcgaacatgaggagttaactgtgagccagctcctgctgtgcctaagggaagggaatcagaaggtggagagacttgaagttgcactcaaggaggcccaagaaagagtttcagattttgaaaagaaaaccaagagaaagaagaaacagaaggagagaccgaatacaaatttgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcagggccatcgatgcacccctcggagctaatagcggagatgagaaacagtgggtttgcactgaaacgaaatgtactggggagaaacttgaccgcaaatgatccatcacaggagtatgttgcaagtgagggtgaagaagatccagaagttgaatttttaaagtcactaacaaccaaacaaaaacagaaacttctcaggaaattagatcgactggagaagaaaaaaaagaaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaagaaaaaaaaatacaaaggaagaaaagaaagaaaaacaagtgttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggacagcaaatggagccattctgattctgacaaaaagtccagaacccataaacatagcccagagaagagaggctctgaaagaaaggaggggagcagcagaagccacggcagggaggaaaggagccggagaagccggagcagaagtcctggtagttacaagcaaagggagacaaggaaacgggcacagcgaaatcctggtgaagagcaaagcagaagaaatgacagcagaagccatggcacagacttgtatagaggagaaaaaatgtacagagagcacccaggaggtacacatactaaagtgacacaaagagaatgaagcagaagtagagaagaaagactgtatgtgacaattacctgggaataaaaatatctccacttttttattgaatacctttagcaaggggtaaattatgtactgttgtctttctaataaaaaagctcaattttaatttttcatctctagactgtcaattcaagtacaaaactacatgagtactatgagaatgaattttgcaaatatttgtaagtaagctattttggggctgtggaaatattttctgttggtaactgtttcttgttccccataccagataaaaaccgcatataactctgtgacattttctttgttctgaaacatcattaaaagaatgacagtaca

SEQ ID NO: 302476 - DNA, 1449 bp, Homo sapiens
gacaaagttacataagaagactccccttgcacgtaaagaaaaatgcaattattttctattctgaatctccagactgctgttttagaaaatcatatctgattatttgctcagcagaagattattgagttgatttagctgtgattttacttaacaaagcttcaactgcattcctactgtggagtccgaaaaaggtagagagatataaatgatacattcaaactgtgatttttgtgaacagggccatcgatgcacccctcggagctaatagcggagatgagaaacagtgggtttgcactgaaacgaaatgtactggggagaaacttgaccgcaaatgatccatcacaggagtatgttgcaagtgagggtgaagaagatccagaagttgaatttttaaagtcactaacaaccaaacaaaaacagaaacttctcaggaaattagatcgactggagaagaaaaaaaagaaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaagaaaaaaaaatacaaaggaagaaaagaaagaaaaacaagtgttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggacagcaaatggagccattctgattctgacaaaaagtccagaacccataaacatagcccagagaagagaggctctgaaagaaaggaggggagcagcagaagccacggcagggaggaaaggagccggagaagccggagcagaagtcctggtagttacaagcaaagggagacaaggaaacgggcacagcgaaatcctggtgaagagcaaagcagaagaaatgacagcagaagccatggcacagacttgtatagaggagaaaaaatgtacagagagcacccaggaggtacacatactaaagtgacacaaagagaatgaagcagaagtagagaagaaagactgtatgtgacaattacctgggaataaaaatatctccacttttttattgaatacctttagcaaggggtaaattatgtactgttgtctttctaataaaaaagctcaattttaatttttcatctctagactgtcaattcaagtacaaaactacatgagtactatgagaatgaattttgcaaatatttgtaagtaagctattttggggctgtggaaatattttctgttggtaactgtttcttgttccccataccagataaaaaccgcatataactctgtgacattttctttgttctgaaacatcattaaaagaatgacagtaca

SEQ ID NO: 302477 - DNA, 735 bp, Homo sapiens
agcggaaacgcagttccggttaggcggctgagtttgtttacgttgctaacagatctagcccctgctttccctagttccagttccaagatggggaaatccttcgccaacttcatgtgcaagaaagactttcatcctgcctccaaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccaccaggagctaaaaaagaaaacaaagagaaagaagaaacagaaggagagaccgaatacaaatttgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcagggccatcgatgcacccctcggagctaatagcggagatgagaaacagtgggtttgcactgaaacgaaatgtactggggagaaacttgaccgcaaatgatccatcacaggagtatgttgcaggtagggatgaaggacgggtaggtatgatgaagggggtacagagc

SEQ ID NO: 302478 - DNA, 805 bp, Homo sapiens
aggcagttgggctgctggagtgcggcgccaccgcggaggacaggggcagctggcgggcagcgggtgagggggtggcggggacgcgagtggcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggtgtgcaggcgactgggaatcatagaagttgactattttggactgcagtttacgggtagcaaaggtgaaagtttatggctaaacctgagaaaccggatctcccagcagatggatgggctagccccttacaggcttaaacttagagtcaagttcttcgtggagcctcatctcatcttacaggagcagactaggtaaagtgagctaaaataaaccaatgtcaaattgacctttggttccctttagaagggccgctgcaccttcccagagatactcacaggcaagtttgttttgatgcggagttccatcttaacttaggttttccatgcaggtccttttgttgaggtggagggggagctacctacttggtccgagtgcattttccaatccttcttttagtttttcttgtctttataaacttgatgggtgagcagggttgaattcttacaaacacttgagataagtgctaccccaggaaaa

SEQ ID NO: 302479 - DNA, 2886 bp, Homo sapiens
aggcagttgggctgctggagtgcggcgccaccgcggaggacaggggcagctggcgggcagcgggtgagggggtggcggggacgcgagtggcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagaaactgctcattggggttggacctgaaggaatctcaatttgtaaagatgactttagcccaattaataggatagcttatcctgtggtgcagatggccacccagtcaggaaagaatgtatatttgacggtcaccaaggaatctgggaacagcatcgtgctcttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaagcaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaaaaggaagaaaaataacacagctactcctcactgcaaaaacatatccatgcgtagaatcaacaactccagtcatgggaccaggaggagctctgggacgcagacacattccttggatgttgattttttttatgatctagtaaaggaataggtaaagtctttgatgtcagtgaagtggcaacatagccaaaaagttgggtaccttttaggaaatgatgttgtaagtctccttaatgtatcctgaggtaagtttcctactggcagcagattttgtaagaattacttttaagaatttcattctttttgtatggtcatggagctccaaccatttttaataggaaagtcttttgtaaattgttgtcgttttaatgtcatttctgtctttataacttgatcaagaatgattggaaggcaaacaggtttacaaatcaattctgtgacttttaaaaagttgacaatgttgtcagatttaaaccagtgtggctagtaaaaagcagctcactcaatgtgggtggctccctattcctttacgctccccctatccctaccccacaagcctttcgattataaaatactaccaatcttgttataagattactgtggagtagtcaagtactccccgggccttctgagctggtggaatattttatttcagactgaaaacagagagcactctccttgggaagggaaagcggagcttgctgagtgagagatggagcctcatggtgtacaactgagggtagttaactcatcacttctcccaagcactcgatcccagcttcacccactggtgttgctttgcttgaactgttcaagccttttatagccttaccataagtatttagatatggtgtccttttctgtttttggggggggagttttgttgtgtttttttaaagtaagtgcttaagtattaactttgggttgtcccctctgtatgtttcgaaggggttttggttctttttgcttctgttttcttaaacatgttttccactcccacttgggcattttggaagctggtcagctagcaggttttctgggatgtcgggagacctagatgaccttatcgggtgcaatactagctaaggtaaagctagaaacctacactgtcactttactgagatttctgagtatacttttcatattgccttaatgtagcagtaatgtgtttatgcatttgtttctttgcacagacattttgtcaaatattaaaactctacttttttatggcacatattagcatataagcctttattccaagaggtatttattttttcacttgtaaaaaaataatgtttccacgtaaagaactctgttatatcctagaggactctgtcttttatattcgggataataaagactttaaagcaaa

SEQ ID NO: 302480 - DNA, 804 bp, Homo sapiens
  misc_feature (715)..(715): n is a, c, g, or t
aggcagttgggctgctggagtgcggcgccaccgcggaggacaggggcagctggcgggcagcgggtgagggggtggcggggacgcgagtggcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggtgtgcaggcgactgggaatcatagaagttgactattttggactgcagtttacgggtagcaaaggtgaaagtttatggctaaacctgagaaaccggatctcccagcagatggatgggctagccccttacaggcttaaacttagagtcaagttcttcgtggagcctcatctcatcttacaggagcagactaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcnaacataaggattggagcgaccaccgttcactgaataccgtttgcaatggtggaggaactgcaaaggatccggggaagagcgaagtcggg

SEQ ID NO: 302481 - DNA, 288 bp, Homo sapiens
gcagccgcctactactactaaattcgcggccgcgtgagatttctgagtatacttttcatattgccttaatgtagcagtaatgtgtttatgcatttgtttctttgcacagacattttgtcaaatattaaaactctacttttttatggcacatattagcatataagcctttattccaagaggtatttattttttcacttgtaaaaaaataatgtttccacgtaaagaactctgttatatcctagaggactctgtcttttatattcgggataataaagactttaaagcaaa

SEQ ID NO: 302482 - DNA, 405 bp, Homo sapiens
  misc_feature (361)..(361): n is a, c, g, or t
  misc_feature (402)..(402): n is a, c, g, or t
tatggtgatgtgataaccccagaggaagcgtctgatttttctgctaggtcatgagcaaatggggatcccacaaaggcacacacatggtgaagaatcactccttctagatctgctttcttttctcttcctgtctcttaggatagcttatcctgtggtgcagatggccacccaaagggctgggattacaggtgtgagccaccgtgtctggccccacataaagtttaggttgggatttttctgtttcttcaaaaaatattgtgatcttgatataggattgcactggaatctgtaggactgcattggggtagtattgggcatctttacaatattgtcttccccatccatggaatatgaagtatcntttccattactgggcatctgtaagttctttcagcagtgtcnttg

SEQ ID NO: 302483 - DNA, 3077 bp, Homo sapiens
aggcagttgggctgctggagtgcggcgccaccgcggaggacaggggcagctggcgggcagcgggtgagggggtggcggggacgcgagtggcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggtgtgcaggcgactgggaatcatagaagttgactattttggactgcagtttacgggtagcaaaggtgaaagtttatggctaaacctgagaaaccggatctcccagcagatggatgggctagccccttacaggcttaaacttagagtcaagttcttcgtggagcctcatctcatcttacaggagcagactaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagaaactgctcattggggttggacctgaaggaatctcaatttgtaaagatgactttagcccaattaataggatagcttatcctgtggtgcagatggccacccagtcaggaaagaatgtatatttgacggtcaccaaggaatctgggaacagcatcgtgctcttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaagcaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaaaaggaagaaaaataacacagctactcctcactgcaaaaacatatccatgcgtagaatcaacaactccagtcatgggaccaggaggagctctgggacgcagacacattccttggatgttgattttttttatgatctagtaaaggaataggtaaagtctttgatgtcagtgaagtggcaacatagccaaaaagttgggtaccttttaggaaatgatgttgtaagtctccttaatgtatcctgaggtaagtttcctactggcagcagattttgtaagaattacttttaagaatttcattctttttgtatggtcatggagctccaaccatttttaataggaaagtcttttgtaaattgttgtcgttttaatgtcatttctgtctttataacttgatcaagaatgattggaaggcaaacaggtttacaaatcaattctgtgacttttaaaaagttgacaatgttgtcagatttaaaccagtgtggctagtaaaaagcagctcactcaatgtgggtggctccctattcctttacgctccccctatccctaccccacaagcctttcgattataaaatactaccaatcttgttataagattactgtggagtagtcaagtactccccgggccttctgagctggtggaatattttatttcagactgaaaacagagagcactctccttgggaagggaaagcggagcttgctgagtgagagatggagcctcatggtgtacaactgagggtagttaactcatcacttctcccaagcactcgatcccagcttcacccactggtgttgctttgcttgaactgttcaagccttttatagccttaccataagtatttagatatggtgtccttttctgtttttggggggggagttttgttgtgtttttttaaagtaagtgcttaagtattaactttgggttgtcccctctgtatgtttcgaaggggttttggttctttttgcttctgttttcttaaacatgttttccactcccacttgggcattttggaagctggtcagctagcaggttttctgggatgtcgggagacctagatgaccttatcgggtgcaatactagctaaggtaaagctagaaacctacactgtcactttactgagatttctgagtatacttttcatattgccttaatgtagcagtaatgtgtttatgcatttgtttctttgcacagacattttgtcaaatattaaaactctacttttttatggcacatattagcatataagcctttattccaagaggtatttattttttcacttgtaaaaaaataatgtttccacgtaaagaactctgttatatcctagaggactctgtcttttatattcgggataataaagactttaaagcaaa

SEQ ID NO: 302484 - DNA, 3183 bp, Homo sapiens
aggcagttgggctgctggagtgcggcgccaccgcggaggacaggggcagctggcgggcagcgggtgagggggtggcggggacgcgagtggcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggtgtgcaggcgactgggaatcatagaagttgactattttggactgcagtttacgggtagcaaaggtgaaagtttatggctaaacctgagaaaccggatctcccagcagatggatgggctagccccttacaggcttaaacttagagtcaagttcttcgtggagcctcatctcatcttacaggagcagactaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagaaactgctcattggggttggacctgaaggaatctcaatttgtaaagatgactttagcccaattaataggatagcttatcctgtggtgcagatggccacccagtcaggaaagaatgtatatttgacggtcaccaaggaatctgggaacagcatcgtgctcttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaagcaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaaaaggaagaaaaataacacagctactcctcactgcaaaaacatatccatgcgtagaatcaacaactccagtcatgggaccaggaggagctctgggacgcagacacattccttggatgttgattttttttatgatctagtaaaggaataggtaaagtctttgatgtcagtgaagtggcaacatagccaaaaagttgggtaccttttaggaaatgatgttgtaagtctccttaatgtatcctgaggtaagtttcctactggcagcagattttgtaagaattacttttaagaatttcattctttttgtatggtcatggagctccaaccatttttaataggaaagtcttttgtaaattgttgtcgttttaatgtcatttctgtctttataacttgatcaagaatgattggaaggcaaacaggtttacaaatcaattctgtgacttttaaaaagttgacaatgttgtcagatttaaaccagtgtggctagtaaaaagcagctcactcaatgtgggtggctccctattcctttacgctccccctatccctaccccacaagcctttcgattataaaatactaccaatcttgttataagattactgtggagtagtcaagtactccccgggccttctgagctggtggaatattttatttcagactgaaaacagagagcactctccttgggaagggaaagcggagcttgctgagtgagagatggagcctcatggtgtacaactgagggtagttaactcatcacttctcccaagcactcgatcccagcttcacccactggtgttgctttgcttgaactgttcaagccttttatagccttaccataagtatttagatatggtgtccttttctgtttttggggggggagttttgttgtgtttttttaaagtaagtgcttaagtattaactttgggttgtcccctctgtatgtttcgaaggggttttggttctttttgcttctgttttcttaaacatgttttccactcccacttgggcattttggaagctggtcagctagcaggttttctgggatgtcgggagacctagatgaccttatcgggtgcaatactagctaaggtaaagctagaaacctacactgtcactttactgagatttctgagtatacttttcatattgccttaatgtagcagtaatgtgtttatgcatttgtttctttgcacagacattttgtcaaatattaaaactctacttttttatggcacatattagcatataagcctttattccaagaggtatttattttttcacttgtaaaaaaataatgtttccacgtaaagaactctgttatatcctagaggactctgtcttttatattcgggataataaagactttaaagcaaaaaaaaagtagagttttaatatttgacaaaatgtctgtgcaaagaaacaaatgcataaacacattactgctacattaaggcaatatgaaaagtatactcagaaatct

SEQ ID NO: 302485 - DNA, 2224 bp, Homo sapiens
  misc_feature (2088)..(2088): n is a, c, g, or t
  misc_feature (2123)..(2123): n is a, c, g, or t
  misc_feature (2152)..(2152): n is a, c, g, or t
  misc_feature (2185)..(2185): n is a, c, g, or t
  misc_feature (2199)..(2199): n is a, c, g, or t
aggcagttgggctgctggagtgcggcgccaccgcggaggacaggggcagctggcgggcagcgggtgagggggtggcggggacgcgagtggcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggtgtgcaggcgactgggaatcatagaagttgactattttggactgcagtttacgggtagcaaaggtgaaagtttatggctaaacctgagaaaccggatctcccagcagatggatgggctagccccttacaggcttaaacttagagtcaagttcttcgtggagcctcatctcatcttacaggagcagactaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagaaactgctcattggggttggacctgaaggaatctcaatttgtaaagatgactttagcccaattaataggatagcttatcctgtggtgcagatggccacccagtcaggaaagaatgtatatttgacggtcaccaaggaatctgggaacagcatcgtgctcttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaagcaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaaaaggaagaaaaataacacagctactcctcactgcaaaaacatatccatgcgtagaatcaacaactccagtcatgggaccaggaggagctctgggacgcagacacattccttggatgttgattttttttatgatctagtaaaggaataggtaaagtctttgatgtcagtgaagtggcaacatagccaaaaagttgggtaccttttaggaaatgatgttgtaagtctccttaatgtatcctgaggtaagtttcctactggcagcagattttgtaagaattacttttaagaatttcattctttttgtatggtcatggagctccaaccatttttaataggaaagtcttttgtaaattgttgtcgtttttaaatggccattttcntgtccttttaataaccttggatccaaggaaatggnttttgggaaaggcaaaccaagggttttanaaaatccaaattcttggtggcctttttaaaaangggttgccaaattnttggtcaaggttttaaaaccccagt

SEQ ID NO: 302486 - DNA, 2589 bp, Homo sapiens
aggcagttgggctgctggagtgcggcgccaccgcggaggacaggggcagctggcgggcagcgggtgagggggtggcggggacgcgagtggcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggtgtgcaggcgactgggaatcatagaagttgactattttggactgcagtttacgggtagcaaaggtgaaagtttatggctaaacctgagaaaccggatctcccagcagatggatgggctagccccttacaggcttaaacttagagtcaagttcttcgtggagcctcatctcatcttacaggagcagactaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagaaactgctcattggggttggacctgaaggaatctcaatttgtaaagatgactttagcccaattaataggatagcttatcctgtggtgcagatggccacccagtcaggaaagaatgtatatttgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaaaaggaagaaaaataacacagctactcctcactgcaaaaacatatccatgcgtagaatcaacaactccagtcatgggaccaggaggagctctgggacgcagacacattccttggatgttgattttttttatgatctagtaaaggaataggtaaagtctttgatgtcagtgaagtggcaacatagccaaaaagttgggtaccttttaggaaatgatgttgtaagtctccttaatgtatcctgaggtaagtttcctactggcagcagattttgtaagaattacttttaagaatttcattctttttgtatggtcatggagctccaaccatttttaataggaaagtcttttgtaaattgttgtcgttttaatgtcatttctgtctttataacttgatcaagaatgattggaaggcaaacaggtttacaaatcaattctgtgacttttaaaaagttgacaatgttgtcagatttaaaccagtgtggctagtaaaaagcagctcactcaatgtgggtggctccctattcctttacgctccccctatccctaccccacaagcctttcgattataaaatactaccaatcttgttataagattactgtggagtagtcaagtactccccgggccttctgagctggtggaatattttatttcagactgaaaacagagagcactctccttgggaagggaaagcggagcttgctgagtgagagatggagcctcatggtgtacaactgagggtagttaactcatcacttctcccaagcactcgatcccagcttcacccactggtgttgctttgcttgaactgttcaagccttttatagccttaccataagtatttagatatggtgtccttttctgtttttggggggggagttttgttgtgtttttttaaagtaagtgcttaagtattaactttgggttgtcccctctgtatgtttcgaaggggttttggttctttttgcttctgttttcttaaacatgttttccactcccacttgggcattttggaagctggtcagctagcaggttttctgggatgtcgggagacctagatgaccttatcgggtgcaatactagctaaggtaaagctagaaacctacactgtcactttactgagatttctgagtatacttttcatattgccttaatgtagcagtaatgtgtttatgcatttgtttctttgcacagacattttgtcaaatattaaaactctacttttttatggcacatattagcatataagcctttattccaagaggtatttattttttcacttgtaaaaaaataatgtttccacgtaaagaactctgttatatcctagaggactctgtcttttatattcgggataataaagactttaaagcaaa

SEQ ID NO: 302487 - DNA, 2127 bp, Homo sapiens
gcagccgcctactactactaaattcgcggccgcgcatcgtgctcttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaagcaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaaaaggaagaaaaataacacagctactcctcactgcaaaaacatatccatgcgtagaatcaacaactccagtcatgggaccaggaggagctctgggacgcagacacattccttggatgttgattttttttatgatctagtaaaggaataggtaaagtctttgatgtcagtgaagtggcaacatagccaaaaagttgggtaccttttaggaaatgatgttgtaagtctccttaatgtatcctgaggtaagtttcctactggcagcagattttgtaagaattacttttaagaatttcattctttttgtatggtcatggagctccaaccatttttaataggaaagtcttttgtaaattgttgtcgttttaatgtcatttctgtctttataacttgatcaagaatgattggaaggcaaacaggtttacaaatcaattctgtgacttttaaaaagttgacaatgttgtcagatttaaaccagtgtggctagtaaaaagcagctcactcaatgtgggtggctccctattcctttacgctccccctatccctaccccacaagcctttcgattataaaatactaccaatcttgttataagattactgtggagtagtcaagtactccccgggccttctgagctggtggaatattttatttcagactgaaaacagagagcactctccttgggaagggaaagcggagcttgctgagtgagagatggagcctcatggtgtacaactgagggtagttaactcatcacttctcccaagcactcgatcccagcttcacccactggtgttgctttgcttgaactgttcaagccttttatagccttaccataagtatttagatatggtgtccttttctgtttttggggggggagttttgttgtgtttttttaaagtaagtgcttaagtattaactttgggttgtcccctctgtatgtttcgaaggggttttggttctttttgcttctgttttcttaaacatgttttccactcccacttgggcattttggaagctggtcagctagcaggttttctgggatgtcgggagacctagatgaccttatcgggtgcaatactagctaaggtaaagctagaaacctacactgtcactttactgagatttctgagtatacttttcatattgccttaatgtagcagtaatgtgtttatgcatttgtttctttgcacagacattttgtcaaatattaaaactctacttttttatggcacatattagcatataagcctttattccaagaggtatttattttttcacttgtaaaaaaataatgtttccacgtaaagaactctgttatatcctagaggactctgtcttttatattcgggataataaagactttaaagcaaa

SEQ ID NO: 302488 - DNA, 2460 bp, Homo sapiens
gcaaatgcctcaagggcatatgggttggctgttatttattagcaagtcaaactaattttaatattaacacgaaaaagagaactcacatatagttttcttcctttcttgcatgaagaagaattttaaatttcctcttacaagttttttcaatttgtttttatttctcagatgtgtttgccaaatgtcactgtggttttatgtaaaactggttctagataatacttagtccttcagaagctgctaatttcagagctaataagaccaaatgacccctgtgtcctttccccagaagcagtcataggcttgtctttttctgcccacctattctgactctcatccctaagtctctcctgagggctgatgatgggcacgggctttctgagaagtcagccaggaatgtggagctgccacctacggctagaagcagagccaccctccctggccatgtgggcatcagcccagaaatgttggcctgagtcagtcagctgagctaaggacacacaatttcaagaagggtctcctgcattgctgcctgaagtgttatagtctactcatgtagagaccacattctgcacagaaagacgtcttcagtaattgctttattcaatgtaccttctttagcgtttcactaaaaatgtaattaatttccttcagtttatactatgtcatagtatttatttttaagcccttgtaaagtataaactttcaacctgtgagacggcaaagatctctaccaattgaaagctagaaatcactgtgatcacaattgatttagaaaattaaatgcactagagaccaggggtgtgcacagagacacaggccccccaccgaggcttgcatgctaacagagactgttggcttttctttcccagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaaaaggaagaaaaataacacagctactcctcactgcaaaaacatatccatgcgtagaatcaacaactccagtcatgggaccaggaggagctctgggacgcagacacattccttggatgttgattttttttatgatctagtaaaggaataggtaaagtctttgatgtcagtgaagtggcaacatagccaaaaagttgggtaccttttaggaaatgatgttgtaagtctccttaatgtatcctgaggtaagtttcctactggcagcagattttgtaagaattacttttaagaatttcattctttttgtatggtcatggagctccaaccatttttaataggaaagtcttttgtaaattgttgtcgttttaatgtcatttctgtctttataacttgatcaagaatgattggaaggcaaacaggtttacaaatcaattctgtgacttttaaaaagttgacaatgttgtcagatttaaaccagtgtggctagtaaaaagcagctcactcaatgtgggtggctccctattcctttacgctccccctatccctaccccacaagcctttcgattataaaatactaccaatcttgttataagattactgtggagtagtcaagtactccccgggccttctgagctggtggaatattttatttcagactgaaaacagagagcactctccttgggaagggaaagcggagcttgctgagtgagagatggagcctcatggtgtacaactgagggtagttaactcatcacttctcccaagcactcgatcccagcttcacccactggtgttgctttgcttgaactgttcaagccttttatagccttaccataagtatttagatatggtgtccttttctgtttttggggggggagttttgttgtgtttttttaaagtaagtgcttaagtattaactttgggttgtcccctctgtatgtttcgaaggggttttggttctttttgcttctgttttcttaaacatgttttccactcccacttgggcattttggaagctggtcagctagcaggttttctgggatgtcgggagacctagatgaccttatcgggtgcaatactagctaaggtaaagctagaaacctacactgtcactttactgagatttctgagtatacttttcatattgccttaatgtagcagtaatgtgtttatgcatttgtttctttgcacagacattttgtcaaatattaaaactctacttttttatggcacatattagcatataagcctttattccaagaggtatttattttttcacttgtaaaaaaataatgtttccacgtaaagaactctgttatatcctagaggactctgtcttttatattcgggataataaagactttaaagcaaa

SEQ ID NO: 302489 - DNA, 408 bp, Homo sapiens
gggtttgctttgatacgtaccatttgctcatccaggctgcattcctttttgttttaggtgtgcaggcgactgggaatcatagaagttgactattttggactgcagtttacgggtagcaaaggtgaaagtttatggctaaacctgagaaaccggatctcccagcagatggatgggctagccccttacaggcttaaacttagagtcaagttcttcgtggagcctcatctcatcttacaggagcagactaggtaaagtgagctaaaataaaccaatgtcaaattgacctttggttccctttagaagggccgctgcaccttcccagagatactcacaggcaagtttgttttgatgcggagttccatcttaacttaggttttccatgcaggtccttttgttgaggtggagggg

SEQ ID NO: 302490 - DNA, 5200 bp, Homo sapiens
ttcagctgggcagctctgggaacttggattaggtggagaggcagttggggggcctcgttgttttgcgtcttagttccgccctcctgtccatcaggagaaggaaaggataaaccctgggccatgaggctacccctgctcctggtttttgcctctgtcattccgggtgctgttctcctactggacaccaggcaatttttaatctataatgaagatcacaagcgctgcgtggatgcagtgagtcccagtgccgtccaaaccgcagcttgcaaccaggatgccgaatcacagaaattccgatgggtgtccgaatctcagattatgagtgttgcatttaaattatgcctgggagtgccatcaaaaacagactgggttgctatcactctctatgcctgtgactcaaaaagtgaatttcagaaatgggagtgcaaaaatgacacacttttggggatcaaaggagaagatttattttttaactacggcaacagacaagaaaagaatattatgctctacaagggatcgggtttatggagcaggtggaagatctatggaaccacagacaatctgtgctccagaggttatgaagccatgtatacgctactaggcaatgccaatggagcaacctgtgcattcccgttcaagtttgaaaacaagtggtacgcagattgcacgagtgctgggcggtcggatggatggctctggtgcggaaccactactgactatgacacagacaagctatttggatattgtccattgaaatttgagggcagtgaaagcttatggaataaagacccgctgaccagcgtttcctaccagataaactccaaatccgctttaacgtggcaccaggcgaggaaaagctgccaacaacagaacgctgagctcctgagcatcacagagatacatgagcaaacatacctgacaggattaaccagttccttgacctcaggactctggattggacttaacagtctgagcttcaacagcggttggcagtggagtgaccgcagtcctttccgatatttgaactggttaccaggaagtccatcagctgaacctggaaaaagctgtgtgtcactaaatcctggaaaaaatgctaaatgggaaaatctggaatgtgttcagaaactgggctatatttgcaaaaagggcaacaccactttaaattcttttgttattccctcagaaagtgatgtgcctactcactgtcctagtcagtggtggccgtatgccggtcactgttacaagattcacagagatgagaaaaaaatccagagggatgctctgaccacctgcaggaaggaaggcggtgacctcacaagtatccacaccatcgaggaattggactttattatctcccagctaggatatgagccaaatgacgaattgtggatcggcttaaatgacattaagattcaaatgtactttgagtggagtgatgggacccctgtaacgtttaccaaatggcttcgtggagaaccaagccatgaaaacaacagacaggaggattgtgtggtgatgaaaggcaaggatgggtactgggcagatcggggctgtgagtggcctcttggctacatctgcaagatgaaatcacgaagccaaggtccagaaatagtggaagtcgaaaaaggctgcaggaaaggctggaaaaaacatcacttttactgctatatgattggacatacgctttcaacatttgcagaagcaaaccaaacctgtaataatgagaatgcttatttaacaactattgaagacagatatgaacaagccttcctgactagtttcgttggcttaaggcctgaaaaatatttctggacaggactttcagatatacaaaccaaagggacttttcagtggaccatcgaggaagaggttcggttcacccactggaattcagatatgccagggcgaaagccagggtgtgttgccatgagaaccgggattgcagggggcttatgggatgttttgaaatgtgatgaaaaggcaaaatttgtgtgcaagcactgggcagaaggagtaacccacccaccgaagcccacgacgactcccgaacccaaatgtccggaggattggggcgccagcagtagaacaagcttgtgtttcaagctgtatgcaaaaggaaaacatgagaagaaaacgtggtttgaatctcgagatttttgtcgagctctgggtggagacttagctagcatcaataacaaagaggaacagcaaacaatatggcgattaataacagctagtggaagctaccacaaactgttttggttgggattgacatatggaagcccttcagaaggttttacttggagtgatggttctcctgtttcatatgaaaactgggcttatggagaacctaataattatcaaaatgttgaatactgtggtgagctgaaaggtgaccctactatgtcttggaatgatattaattgtgaacaccttaacaactggatttgccagatacaaaaaggacaaacaccaaaacctgagccaacaccagctcctcaagacaatccaccagttactgaagatgggtgggttatttacaaagactaccagtattatttcagcaaagagaaggaaaccatggacaatgcgcgagcgttttgcaagaggaattttggtgatcttgtttctattcaaagtgaaagtgaaaagaagtttctatggaaatatgtaaacagaaatgatgcacagtctgcatattttattggtttattgatcagcttggataaaaagtttgcttggatggatggaagcaaagtggattacgtgtcttgggccacaggtgaacccaattttgcaaatgaagatgaaaactgtgtgaccatgtattcaaattcagggttttggaatgacattaactgtggctatccaaacgccttcatttgccagcgacataacagtagtatcaatgctaccacagttatgcctaccatgccctcggtcccatcagggtgcaaggaaggttggaatttctacagcaacaagtgtttcaaaatctttggatttatggaagaagaaagaaaaaattggcaagaggcacgaaaagcttgtataggctttggagggaatctggtctccatacaaaatgaaaaagagcaagcatttcttacctatcacatgaaggactccactttcagtgcctggactgggctgaatgatgtcaattcagaacacacgttcctttggacggatggacgaggagtccattacacaaactgggggaaaggttaccctggtggaagaagaagcagtctttcttatgaagatgctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcttcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatatcctcaagtggcataaaaatgtagtcagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtgaaataaaactgtaaatttgcataactggatgtacttagataatgtgaaataaacattaaagacaaggtctatttttaatagatttgcatttt

SEQ ID NO: 302491 - DNA, 4454 bp, Homo sapiens
  misc_feature (37)..(37): n is a, c, g, or t
ttgctggggtgactccagaggatcccgggagtagtcnaaagacccgctgaccagcgtttcctaccagataaactccaaatccgctttaacgtggcaccaggcgaggaaaagctgccaacaacagaacgctgagctcctgagcatcacagagatacatgagcaaacatacctgacaggattaaccagttccttgacctcaggactctggattggacttaacagtctgagcttcaacagcggttggcagtggagtgaccgcagtcctttccgatatttgaactggttaccaggaagtccatcagctgaacctggaaaaagctgtgtgtcactaaatcctggaaaaaatgctaaatgggaaaatctggaatgtgttcagaaactgggctatatttgcaaaaagggcaacaccactttaaattcttttgttattccctcagaaagtgatgtgcctactcactgtcctagtcagtggtggccgtatgccggtcactgttacaagattcacagagatgagaaaaaaatccagagggatgctctgaccacctgcaggaaggaaggcggtgacctcacaagtatccacaccatcgaggaattggactttattatctcccagctaggatatgagccaaatgacgaattgtggatcggcttaaatgacattaagattcaaatgtactttgagtggagtgatgggacccctgtaacgtttaccaaatggcttcgtggagaaccaagccatgaaaacaacagacaggaggattgtgtggtgatgaaaggcaaggatgggtactgggcagatcggggctgtgagtggcctcttggctacatctgcaagatgaaatcacgaagccaaggtccagaaatagtggaagtcgaaaaaggctgcaggaaaggctggaaaaaacatcacttttactgctatatgattggacatacgctttcaacatttgcagaagcaaaccaaacctgtaataatgagaatgcttatttaacaactattgaagacagatatgaacaagccttcctgactagtttcgttggcttaaggcctgaaaaatatttctggacaggactttcagatatacaaaccaaagggacttttcagtggaccatcgaggaagaggttcggttcacccactggaattcagatatgccagggcgaaagccagggtgtgttgccatgagaaccgggattgcagggggcttatgggatgttttgaaatgtgatgaaaaggcaaaatttgtgtgcaagcactgggcagaaggagtaacccacccaccgaagcccacgacgactcccgaacccaaatgtccggaggattggggcgccagcagtagaacaagcttgtgtttcaagctgtatgcaaaaggaaaacatgagaagaaaacgtggtttgaatctcgagatttttgtcgagctctgggtggagacttagctagcatcaataacaaagaggaacagcaaacaatatggcgattaataacagctagtggaagctaccacaaactgttttggttgggattgacatatggaagcccttcagaaggttttacttggagtgatggttctcctgtttcatatgaaaactgggcttatggagaacctaataattatcaaaatgttgaatactgtggtgagctgaaaggtgaccctactatgtcttggaatgatattaattgtgaacaccttaacaactggatttgccagatacaaaaaggacaaacaccaaaacctgagccaacaccagctcctcaagacaatccaccagttactgaagatgggtgggttatttacaaagactaccagtattatttcagcaaagagaaggaaaccatggacaatgcgcgagcgttttgcaagaggaattttggtgatcttgtttctattcaaagtgaaagtgaaaagaagtttctatggaaatatgtaaacagaaatgatgcacagtctgcatattttattggtttattgatcagcttggataaaaagtttgcttggatggatggaagcaaagtggattacgtgtcttgggccacaggtgaacccaattttgcaaatgaagatgaaaactgtgtgaccatgtattcaaattcagggttttggaatgacattaactgtggctatccaaacgccttcatttgccagcgacataacagtagtatcaatgctaccacagttatgcctaccatgccctcggtcccatcagggtgcaaggaaggttggaatttctacagcaacaagtgtttcaaaatctttggatttatggaagaagaaagaaaaaattggcaagaggcacgaaaagcttgtataggctttggagggaatctggtctccatacaaaatgaaaaagagcaagcatttcttacctatcacatgaaggactccactttcagtgcctggactgggctgaatgatgtcaattcagaacacacgttcctttggacggatggacgaggagtccattacacaaactgggggaaaggttaccctggtggaagaagaagcagtctttcttatgaagatgctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcttcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatatcctcaagtggcataaaaatgtagtcagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtgaaataaaactgtaaatttgcataactggatgtacttagataatgtgaaataaacattaaagacaaggtctatttttaatagatttgcatttt

SEQ ID NO: 302492 - DNA, 1954 bp, Homo sapiens
tgaaataatgtcagagaggcacagttctttggctgtatctgcctgttatcatacgggagccccaaggatatggtggctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggctactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcttcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatatcctcaagtggcataaaaatgtagtcagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtgaaataaaactgtaaatttgcataactggatgtacttagataatgtgaaataaacattaaagacaaggtctatttttaatagatttgcatttt

SEQ ID NO: 302493 - DNA, 5146 bp, Homo sapiens
ttcagctgggcagctctgggaacttggattaggtggagaggcagttggggggcctcgttgttttgcgtcttagttccgccctcctgtccatcaggagaaggaaaggataaaccctgggccatgaggctacccctgctcctggtttttgcctctgtcattccgggtgctgttctcctactggacaccaggcaatttttaatctataatgaagatcacaagcgctgcgtggatgcagtgagtcccagtgccgtccaaaccgcagcttgcaaccaggatgccgaatcacagaaattccgatgggtgtccgaatctcagattatgagtgttgcatttaaattatgcctgggagtgccatcaaaaacagactgggttgctatcactctctatgcctgtgactcaaaaagtgaatttcagaaatgggagtgcaaaaatgacacacttttggggatcaaaggagaagatttattttttaactacggcaacagacaagaaaagaatattatgctctacaagggatcgggtttatggagcaggtggaagatctatggaaccacagacaatctgtgctccagaggttatgaagccatgtatacgctactaggcaatgccaatggagcaacctgtgcattcccgttcaagtttgaaaacaagtggtacgcagattgcacgagtgctgggcggtcggatggatggctctggtgcggaaccactactgactatgacacagacaagctatttggatattgtccattgaaatttgagggcagtgaaagcttatggaataaagacccgctgaccagcgtttcctaccagataaactccaaatccgctttaacgtggcaccaggcgaggaaaagctgccaacaacagaacgctgagctcctgagcatcacagagatacatgagcaaacatacctgacaggattaaccagttccttgacctcaggactctggattggacttaacagtctgagcttcaacagcggttggcagtggagtgaccgcagtcctttccgatatttgaactggttaccaggaagtccatcagctgaacctggaaaaagctgtgtgtcactaaatcctggaaaaaatgctaaatgggaaaatctggaatgtgttcagaaactgggctatatttgcaaaaagggcaacaccactttaaattcttttgttattccctcagaaagtgatgtgcctactcactgtcctagtcagtggtggccgtatgccggtcactgttacaagattcacagagatgagaaaaaaatccagagggatgctctgaccacctgcaggaaggaaggcggtgacctcacaagtatccacaccatcgaggaattggactttattatctcccagctaggatatgagccaaatgacgaattgtggatcggcttaaatgacattaagattcaaatgtactttgagtggagtgatgggacccctgtaacgtttaccaaatggcttcgtggagaaccaagccatgaaaacaacagacaggaggattgtgtggtgatgaaaggcaaggatgggtactgggcagatcggggctgtgagtggcctcttggctacatctgcaagatgaaatcacgaagccaaggtccagaaatagtggaagtcgaaaaaggctgcaggaaaggctggaaaaaacatcacttttactgctatatgattggacatacgctttcaacatttgcagaagcaaaccaaacctgtaataatgagaatgcttatttaacaactattgaagacagatatgaacaagccttcctgactagtttcgttggcttaaggcctgaaaaatatttctggacaggactttcagatatacaaaccaaagggacttttcagtggaccatcgaggaagaggttcggttcacccactggaattcagatatgccagggcgaaagccagggtgtgttgccatgagaaccgggattgcagggggcttatgggatgttttgaaatgtgatgaaaaggcaaaatttgtgtgcaagcactgggcagaaggagtaacccacccaccgaagcccacgacgactcccgaacccaaatgtccggaggattggggcgccagcagtagaacaagcttgtgtttcaagctgtatgcaaaaggaaaacatgagaagaaaacgtggtttgaatctcgagatttttgtcgagctctgggtggagacttagctagcatcaataacaaagaggaacagcaaacaatatggcgattaataacagctagtggaagctaccacaaactgttttggttgggattgacatatggaagcccttcagaaggttttacttggagtgatggttctcctgtttcatatgaaaactgggcttatggagaacctaataattatcaaaatgttgaatactgtggtgagctgaaaggtgaccctactatgtcttggaatgatattaattgtgaacaccttaacaactggatttgccagatacaaaaaggacaaacaccaaaacctgagccaacaccagctcctcaagacaatccaccagttactgaagatgggtgggttatttacaaagactaccagtattatttcagcaaagagaaggaaaccatggacaatgcgcgagcgttttgcaagaggaattttggtgatcttgtttctattcaaagtgaaagtgaaaagaagtttctatggaaatatgtaaacagaaatgatgcacagtctgcatattttattggtttattgatcagcttggataaaaagtttgcttggatggatggaagcaaagtggattacgtgtcttgggccacaggtgaacccaattttgcaaatgaagatgaaaactgtgtgaccatgtattcaaattcagggttttggaatgacattaactgtggctatccaaacgccttcatttgccagcgacataacagtagtatcaatgctaccacagttatgcctaccatgccctcggtcccatcagggtgcaaggaaggttggaatttctacagcaacaagtgtttcaaaatctttggatttatggaagaagaaagaaaaaattggcaagaggcacgaaaagcttgtataggctttggagggaatctggtctccatacaaaatgaaaaagagcaagcatttcttacctatcacatgaaggactccactttcagtgcctggactgggctgaatgatgtcaattcagaacacacgttcctttggacggatggacgaggagtccattacacaaactgggggaaaggttaccctggtggaagaagaagcagtctttcttatgaagatgctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcttcctacaaaggatatatttgtaaaagaccaaaaattattgatgctaaacctactcatgaattacttacaacaaaagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatatcctcaagtggcataaaaatgtagtcagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtgaaataaaactgtaaatttgcataactggatgtacttagataatgtgaaataaacattaaagacaaggtctatttttaatagatttgcatttt

SEQ ID NO: 302494 - DNA, 5163 bp, Homo sapiens
ttcagctgggcagctctgggaacttggattaggtggagaggcagttggggggcctcgttgttttgcgtcttagttccgccctcctgtccatcaggagaaggaaaggataaaccctgggccatgaggctacccctgctcctggtttttgcctctgtcattccgggtgctgttctcctactggacaccaggcaatttttaatctataatgaagatcacaagcgctgcgtggatgcagtgagtcccagtgccgtccaaaccgcagcttgcaaccaggatgccgaatcacagaaattccgatgggtgtccgaatctcagattatgagtgttgcatttaaattatgcctgggagtgccatcaaaaacagactgggttgctatcactctctatgcctgtgactcaaaaagtgaatttcagaaatgggagtgcaaaaatgacacacttttggggatcaaaggagaagatttattttttaactacggcaacagacaagaaaagaatattatgctctacaagggatcgggtttatggagcaggtggaagatctatggaaccacagacaatctgtgctccagaggttatgaagccatgtatacgctactaggcaatgccaatggagcaacctgtgcattcccgttcaagtttgaaaacaagtggtacgcagattgcacgagtgctgggcggtcggatggatggctctggtgcggaaccactactgactatgacacagacaagctatttggatattgtccattgaaatttgagggcagtgaaagcttatggaataaagacccgctgaccagcgtttcctaccagataaactccaaatccgctttaacgtggcaccaggcgaggaaaagctgccaacaacagaacgctgagctcctgagcatcacagagatacatgagcaaacatacctgacaggattaaccagttccttgacctcaggactctggattggacttaacagtctgagcttcaacagcggttggcagtggagtgaccgcagtcctttccgatatttgaactggttaccaggaagtccatcagctgaacctggaaaaagctgtgtgtcactaaatcctggaaaaaatgctaaatgggaaaatctggaatgtgttcagaaactgggctatatttgcaaaaagggcaacaccactttaaattcttttgttattccctcagaaagtgatgtgcctactcactgtcctagtcagtggtggccgtatgccggtcactgttacaagattcacagagatgagaaaaaaatccagagggatgctctgaccacctgcaggaaggaaggcggtgacctcacaagtatccacaccatcgaggaattggactttattatctcccagctaggatatgagccaaatgacgaattgtggatcggcttaaatgacattaagattcaaatgtactttgagtggagtgatgggacccctgtaacgtttaccaaatggcttcgtggagaaccaagccatgaaaacaacagacaggaggattgtgtggtgatgaaaggcaaggatgggtactgggcagatcggggctgtgagtggcctcttggctacatctgcaagatgaaatcacgaagccaaggtccagaaatagtggaagtcgaaaaaggctgcaggaaaggctggaaaaaacatcacttttactgctatatgattggacatacgctttcaacatttgcagaagcaaaccaaacctgtaataatgagaatgcttatttaacaactattgaagacagatatgaacaagccttcctgactagtttcgttggcttaaggcctgaaaaatatttctggacaggactttcagatatacaaaccaaagggacttttcagtggaccatcgaggaagaggttcggttcacccactggaattcagatatgccagggcgaaagccagggtgtgttgccatgagaaccgggattgcagggggcttatgggatgttttgaaatgtgatgaaaaggcaaaatttgtgtgcaagcactgggcagaaggagtaacccacccaccgaagcccacgacgactcccgaacccaaatgtccggaggattggggcgccagcagtagaacaagcttgtgtttcaagctgtatgcaaaaggaaaacatgagaagaaaacgtggtttgaatctcgagatttttgtcgagctctgggtggagacttagctagcatcaataacaaagaggaacagcaaacaatatggcgattaataacagctagtggaagctaccacaaactgttttggttgggattgacatatggaagcccttcagaaggttttacttggagtgatggttctcctgtttcatatgaaaactgggcttatggagaacctaataattatcaaaatgttgaatactgtggtgagctgaaaggtgaccctactatgtcttggaatgatattaattgtgaacaccttaacaactggatttgccagatacaaaaaggacaaacaccaaaacctgagccaacaccagctcctcaagacaatccaccagttactgaagatgggtgggttatttacaaagactaccagtattatttcagcaaagagaaggaaaccatggacaatgcgcgagcgttttgcaagaggaattttggtgatcttgtttctattcaaagtgaaagtgaaaagaagtttctatggaaatatgtaaacagaaatgatgcacagtctgcatattttattggtttattgatcagcttggataaaaagtttgcttggatggatggaagcaaagtggattacgtgtcttgggccacaggtgaacccaattttgcaaatgaagatgaaaactgtgtgaccatgtattcaaattcagggttttggaatgacattaactgtggctatccaaacgccttcatttgccagcgacataacagtagtatcaatgctaccacagttatgcctaccatgccctcggtcccatcagggtgcaaggaaggttggaatttctacagcaacaagtgtttcaaaatctttggatttatggaagaagaaagaaaaaattggcaagaggcacgaaaagcttgtataggctttggagggaatctggtctccatacaaaatgaaaaagagcaagcatttcttacctatcacatgaaggactccactttcagtgcctggactgggctgaatgatgtcaattcagaacacacgttcctttggacggatggacgaggagtccattacacaaactgggggaaaggttaccctggtggaagaagaagcagtctttcttatgaagatgctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcttcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatatcctcaagtggcataaaaatgtagtcagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtgaaataaaactgtaaatttgcataactggatgtacttagataatgtgaaataaacattaaagacaaggtctatttttaatagatttgcatttt

SEQ ID NO: 302495 - DNA, 1486 bp, Homo sapiens
ggctcccaaagtgctgggattacaggcgtgagccaccactcctggcctggagtcttattttacttttcattcaaatgctttttaacatcttaggcttcagcaggctaatttcaaaacccctagccttgaatgttttacttatgggtagattgggtaggttttaagggtgagtatcagtggctcaaatgtaacttggagaatcacatttccagatcttctaatgtactcaaacgcaccatacaaccataggcaactgctatggctcagacagagagacagatagatgataggtaggtagatatatagataaaggtacagatcttttttttctacctgtatttttatatctatcatatcataatatcatatatcaatcaacacacatcaaatgtggaggattccatgtatttgtgaggcaaataatatttgctatctacctgcaattattctgggtttttataaatttttttttttttacacacagttattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatatcctcaagtggcataaaaatgtagtcagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtgaaataaaactgtaaatttgcataactggatgtacttagataatgtgaaataaacattaaagacaaggtctatttttaatagatttgcatttt

SEQ ID NO: 302496 - DNA, 735 bp, Homo sapiens
attgaaagtgctgcagaatccagttttctgtcatatcgggttgagccacttaaaagtaaaaccaatttttggataggattgttcagaaatgttgaaggtaatttttgcagcatgcttatttaatcacaaatattgtaaaatgttgtatgtaaaacaaggtttcgtttccaaaatgtgttgccttaaaaatgattaattcatgaggaatttgaaaattcaaactcatatttttatttaagaactgaaatttaaaatgagtttcatatcatgctatcctcaaagttgctaattaaaaaatatcttttgtagctaagatagtttgaggagctttaaaaagcattttctatgttttcgtggggccaggaaaaaaatgctaaggaaaggataagtataaatatttgtactaattagaaatacggttttaactaaagctatacggtaaacctattctttttcgtttccttccctgtaataattagtcattatagtcttgcctgttaagtctggttataaatgactattgattctagtataaaagaatatgcttagaaatttcgcataaattggctgaacttattttaagataggttatatttaacttttgtctttattggttttatctgatgaccagggacgtggctgtggataaataacagtccggtctcctttgtcaactggaacacaggagatccctctggtgaacggaatgattgtgtagctttacatgcgtcttct

SEQ ID NO: 302497 - DNA, 199 bp, Homo sapiens
ccggagtcagatcacacagcatggattcctttccatggtcactgttactatattgagtcctcatatacaagaaactggggccaagcttctctggaatgtcttcgaatgggtgagtgccacatttcctgaaggaaaactccataatcatctattctggggtccactgacactatacatgaaatatacaaagaatgtaaaa

SEQ ID NO: 302498 - DNA, 410 bp, Homo sapiens
caagttcttgtttgtttgttttgctttctttaaaaatataggattaaccagttccttgacctcaggactctggattggacttaacagtctgagcttcaacagcggttggcagtggagtgaccgcagtcctttccgatatttgaactggttaccaggtagggttaagcctgtttgtgtcgaattaatccaaatttaagtcatctagacgccccgaagacgtttattatctcacctgttgatctcaaagagaagaattgggagacttcatcaaatacagttcatttcaccttgttttgaaatctatgctagatttccatttactgaattgtaaggttataccagcttcctgggatagggatttgtctgccaggattctcacacaaaacaataaaggtctctgtttaaagttt

SEQ ID NO: 302499 - DNA, 720 bp, Homo sapiens
taatttttaaaatacccaaagaattgagcaaaaaggactttggcaaggcaggttgttggatttaaaaccgttctcccattaatgccaaagccagcagaggtaccaactatagctccacggccagaagataccagcagctctgcctttactgaaatttcagctggagaaaggtccacagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaaattg

SEQ ID NO: 302500 - DNA, 666 bp, Homo sapiens
taatttttaaaatacccaaagaattgagcaaaaaggactttggcaaggcaggttgttggatttaaaaccgttctcccattaatgccaaagccagcagaggtaccaactatagctccacggccagaagataccagcagctctgcctttactgaaatttcagctggagaaaggtccacagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccgacctgggggtgtctgggctgctaaactcatcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaaattg

SEQ ID NO: 302501 - DNA, 880 bp, Homo sapiens
  misc_feature (852)..(852): n is a, c, g, or t
  misc_feature (855)..(855): n is a, c, g, or t
  misc_feature (863)..(863): n is a, c, g, or t
cctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttggatattcttgaaagtttatatttttataattttttcttacatcagatgtttctttgcagtggcttaatgtttgaaattattttgtggctttttttgtaaatattgaaatgtagcaataatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattctaataaaatgtacatatataaatccaaccacaaaaacanagnacgtaagngccgcgggcttattccc

SEQ ID NO: 302502 - DNA, 1205 bp, Homo sapiens
cgccggccggacggacgccgctcccgccgcctccgctccgcccgccgcgccgcgcgcccttgctcggcatgtcggcggccgtggcgtgcgtggattacttcgccgccgacgtgctcatggccatctcttcgggcgccgtggtgcaccgcgggcggcccggccccgagggcgcgggccccgccgccggcctggatgtgcgcgcggcgcgccgcgaggccgcctcacccgggaccccggggccacccccgccgccccccgccgcttctggcccgggccccggcgccgccgcggcgccccacctgctggccgccagcatcctggccgacctgcgcggcggacccggagccgccccggggggcgcctcgcccgcctcctcctcctcagccgcctcgtccccgtcctcgggccgcgcccccggcgccgcgccctccgccgccgccaagagccaccgctgtcccttcccggactgcgccaaagcctactacaagtcctcgcacctaaagtcgcacctgcggacgcacacaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggagggggcctgagactggacctgggtctgcctgacctcagagcagtgtccaggggcttggagagacctgcgcccacccctccactctcccaggagtcgctgatcactgggacctggttccagccgtttgcaggggaggcggctccgagaggcgtgtgctttccgtgggtggcgcccctcccccgccctgcctggcctcatccttgtatttaattaattaaacaagcccctttttaaacccta

SEQ ID NO: 302503 - DNA, 2429 bp, Homo sapiens
acgcggtcgggcggcgagcggatggccgccccggcggcagtggcgggggctccgggggcccagcgaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggagggggcctgagactggacctgggtctgcctgacctcagaggtggctctcaggatgggtgacggggggcttgtgtctgtaaatagccatgatactaactttcttcccatctgtgcaacggggcccccccagggcagctaggaggtcctcccctctcctctccaccaccccgtgctgcccccctcccggggtggggtttgggggggtggagtggacttctgggagccggcccggggaaagcaccccctgccccatccctgcagattgggatgaagtgttcagacagccatagaggagtcgggggttgacacggcccctgcctctccccaccccaccccaccccaccgaaagccatgggagtagttcagggaaatgggggtgcagcccagccaccccccattcgggtactcaatctcaggtgtccacaagttctgcccacggtaggggctgcctggccccccagacctcgggggtagagccaggagtggggcagcgttaggatgcccggaggggctccaggtgttgcttctgagacctgggatggggagggaggggacctctgggttcttccaaagaacatttgactcagtggggtcgggagggaatcctggcttatttattttcctctgtcctcgggtgtgggggccctagctcgccctctctgggtgggtgggtgagagaggctgcaggggaggctggcaccgggcttgggcctccagtccctgccttgctgactttggccgttgcggtatcacgtgacaatcaactctcccttaacgacgactgcggctgttgggctgcgctgccctccctggcctgcaggtggggccgtggagcccatgcccgccggggttgcaggctcttccgggcctgggctgcagcctggcccggccctgcttccctggcctcccctccttctcctgggtgcttggaagaggtgggtcctggcccgtggttgaggtcttgcctcgtggactggaagcagagggctggctgtgcagcctcctggggtagctcgttttttttgcaccgggtagaatattttttcaggcacggattcctttttttctgggcccccatgggtggtccggcatcctcagggggtgtgagtgtgtgtggggggtctctgagctgaacttgggtggggtggggacttgttcctcgggggccacctttgtgtccttgtcagcggtcgtcctgctgtggcctgggttgcatttcctcttggggggggtattgaggacccccagcctggaatgagaagggtccccggttccatgtcagacccagaaaggtggatccccccactgttggctgcaggaggtttttggtacccccttttgttccagaaccgtcctgcctctcgcttggggacaggggggctttggatggcactggtgtgcacctggacccagccccggcctggcaggatccagggatgggtgcctgggatcctggggggagggaggcaggggacgcccttctggagctgggctcggagggtcctgccccatccagccctcggctctctgtgttctctgtccctagcctcaaaccctcttctggcagcgctagtgagatgccttagtctgtgggggtgggtgggggactggggccccgttttcctttgtgagtcttggttggccccagccctggcaggggcctgtctggagcaggggtaggtagggctgtgggttccagaactctataactgggcccctctccagtgtccaggggcttggagagacctgcgcccacccctccactctcccaggagtcgctgatcactgggacctggttccagccgtttgcaggggaggcggctccgagaggcgtgtgctttccgtgggtggcgcccctcccccgccctgcctggcctcatccttgtatttaattaattaaacaagcccctttttaaacccta

SEQ ID NO: 302504 - DNA, 2596 bp, Homo sapiens
cgccggccggacggacgccgctcccgccgcctccgctccgcccgccgcgccgcgcgcccttgctcggcatgtcggcggccgtggcgtgcgtggattacttcgccgccgacgtgctcatggccatctcttcgggcgccgtggtgcaccgcgggcggcccggccccgagggcgcgggccccgccgccggcctggatgtgcgcgcggcgcgccgcgaggccgcctcacccgggaccccggggccacccccgccgccccccgccgcttctggcccgggccccggcgccgccgcggcgccccacctgctggccgccagcatcctggccgacctgcgcggcggacccggagccgccccggggggcgcctcgcccgcctcctcctcctcagccgcctcgtccccgtcctcgggccgcgcccccggcgccgcgccctccgccgccgccaagagccaccgctgtcccttcccggactgcgccaaagcctactacaagtcctcgcacctaaagtcgcacctgcggacgcacacaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggagggggcctgagactggacctgggtctgcctgacctcagaggtggctctcaggatgggtgacggggggcttgtgtctgtaaatagccatgatactaactttcttcccatctgtgcaacggggcccccccagggcagctaggaggtcctcccctctcctctccaccaccccgtgctgcccccctcccggggtggggtttgggggggtggagtggacttctgggagccggcccggggaaagcaccccctgccccatccctgcagattgggatgaagtgttcagacagccatagaggagtcgggggttgacacggcccctgcctctccccaccccaccccaccccaccgaaagccatgggagtagttcagggaaatgggggtgcagcccagccaccccccattcgggtactcaatctcaggtgtccacaagttctgcccacggtaggggctgcctggccccccagacctcgggggtagagccaggagtggggcagcgttaggatgcccggaggggctccaggtgttgcttctgagacctgggatggggagggaggggacctctgggttcttccaaagaacatttgactcagtggggtcgggagggaatcctggcttatttattttcctctgtcctcgggtgtgggggccctagctcgccctctctgggtgggtgggtgagagaggctgcaggggaggctggcaccgggcttgggcctccagtccctgccttgctgactttggccgttgcggtatcacgtgacaatcaactctcccttaacgacgactgcggctgttgggctgcgctgccctccctggcctgcaggtggggccgtggagcccatgcccgccggggttgcaggctcttccgggcctgggctgcagcctggcccggccctgcttccctggcctcccctccttctcctgggtgcttggaagaggtgggtcctggcccgtggttgaggtcttgcctcgtggactggaagcagagggctggctgtgcagcctcctggggtagctcgttttttttgcaccgggtagaatattttttcaggcacggattcctttttttctgggcccccatgggtggtccggcatcctcagggggtgtgagtgtgtgtggggggtctctgagctgaacttgggtggggtggggacttgttcctcgggggccacctttgtgtccttgtcagcggtcgtcctgctgtggcctgggttgcatttcctcttggggggggtattgaggacccccagcctggaatgagaagggtccccggttccatgtcagacccagaaaggtggatccccccactgttggctgcaggaggtttttggtacccccttttgttccagaaccgtcctgcctctcgcttggggacaggggggctttggatggcactggtgtgcacctggacccagccccggcctggcaggatccagggatgggtgcctgggatcctggggggagggaggcaggggacgcccttctggagctgggctcggagggtcctgccccatccagccctcggctctctgtgttctctgtccctagcctcaaaccctcttctggcagcgctagtgagatgccttagtctgtgggggtgggtggttgtctttattgttatctcttttatttt

SEQ ID NO: 302505 - DNA, 2887 bp, Homo sapiens
cgccggccggacggacgccgctcccgccgcctccgctccgcccgccgcgccgcgcgcccttgctcggcatgtcggcggccgtggcgtgcgtggattacttcgccgccgacgtgctcatggccatctcttcgggcgccgtggtgcaccgcgggcggcccggccccgagggcgcgggccccgccgccggcctggatgtgcgcgcggcgcgccgcgaggccgcctcacccgggaccccggggccacccccgccgccccccgccgcttctggcccgggccccggcgccgccgcggcgccccacctgctggccgccagcatcctggccgacctgcgcggcggacccggagccgccccggggggcgcctcgcccgcctcctcctcctcagccgcctcgtccccgtcctcgggccgcgcccccggcgccgcgccctccgccgccgccaagagccaccgctgtcccttcccggactgcgccaaagcctactacaagtcctcgcacctaaagtcgcacctgcggacgcacacaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggagggggcctgagactggacctgggtctgcctgacctcagaggtggctctcaggatgggtgacggggggcttgtgtctgtaaatagccatgatactaactttcttcccatctgtgcaacggggcccccccagggcagctaggaggtcctcccctctcctctccaccaccccgtgctgcccccctcccggggtggggtttgggggggtggagtggacttctgggagccggcccggggaaagcaccccctgccccatccctgcagattgggatgaagtgttcagacagccatagaggagtcgggggttgacacggcccctgcctctccccaccccaccccaccccaccgaaagccatgggagtagttcagggaaatgggggtgcagcccagccaccccccattcgggtactcaatctcaggtgtccacaagttctgcccacggtaggggctgcctggccccccagacctcgggggtagagccaggagtggggcagcgttaggatgcccggaggggctccaggtgttgcttctgagacctgggatggggagggaggggacctctgggttcttccaaagaacatttgactcagtggggtcgggagggaatcctggcttatttattttcctctgtcctcgggtgtgggggccctagctcgccctctctgggtgggtgggtgagagaggctgcaggggaggctggcaccgggcttgggcctccagtccctgccttgctgactttggccgttgcggtatcacgtgacaatcaactctcccttaacgacgactgcggctgttgggctgcgctgccctccctggcctgcaggtggggccgtggagcccatgcccgccggggttgcaggctcttccgggcctgggctgcagcctggcccggccctgcttccctggcctcccctccttctcctgggtgcttggaagaggtgggtcctggcccgtggttgaggtcttgcctcgtggactggaagcagagggctggctgtgcagcctcctggggtagctcgttttttttgcaccgggtagaatattttttcaggcacggattcctttttttctgggcccccatgggtggtccggcatcctcagggggtgtgagtgtgtgtggggggtctctgagctgaacttgggtggggtggggacttgttcctcgggggccacctttgtgtccttgtcagcggtcgtcctgctgtggcctgggttgcatttcctcttggggggggtattgaggacccccagcctggaatgagaagggtccccggttccatgtcagacccagaaaggtggatccccccactgttggctgcaggaggtttttggtacccccttttgttccagaaccgtcctgcctctcgcttggggacaggggggctttggatggcactggtgtgcacctggacccagccccggcctggcaggatccagggatgggtgcctgggatcctggggggagggaggcaggggacgcccttctggagctgggctcggagggtcctgccccatccagccctcggctctctgtgttctctgtccctagcctcaaaccctcttctggcagcgctagtgagatgccttagtctgtgggggtgggtgggggactggggccccgttttcctttgtgagtcttggttggccccagccctggcaggggcctgtctggagcaggggtaggtagggctgtgggttccagaactctataactgggcccctctccagtgtccaggggcttggagagacctgcgcccacccctccactctcccaggagtcgctgatcactgggacctggttccagccgtttgcaggggaggcggctccgagaggcgtgtgctttccgtgggtggcgcccctcccccgccctgcctggcctcatccttgtatttaattaattaaacaagcccctttttaaacccta

SEQ ID NO: 302506 - DNA, 3043 bp, Homo sapiens
cgccggccggacggacgccgctcccgccgcctccgctccgcccgccgcgccgcgcgcccttgctcggcatgtcggcggccgtggcgtgcgtggattacttcgccgccgacgtgctcatggccatctcttcgggcgccgtggtgcaccgcgggcggcccggccccgagggcgcgggccccgccgccggcctggatgtgcgcgcggcgcgccgcgaggccgcctcacccgggaccccggggccacccccgccgccccccgccgcttctggcccgggccccggcgccgccgcggcgccccacctgctggccgccagcatcctggccgacctgcgcggcggacccggagccgccccggggggcgcctcgcccgcctcctcctcctcagccgcctcgtccccgtcctcgggccgcgcccccggcgccgcgccctccgccgccgccaagagccaccgctgtcccttcccggactgcgccaaagcctactacaagtcctcgcacctaaagtcgcacctgcggacgcacacaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggagggggcctgagactggacctgggtctgcctgacctcagaggtggctctcaggatgggtgacggggggcttgtgtctgtaaatagccatgatactaactttcttcccatctgtgcaacggggcccccccagggcagctaggaggtcctcccctctcctctccaccaccccgtgctgcccccctcccggggtggggtttgggggggtggagtggacttctgggagccggcccggggaaagcaccccctgccccatccctgcagattgggatgaagtgttcagacagccatagaggagtcgggggttgacacggcccctgcctctccccaccccaccccaccccaccgaaagccatgggagtagttcagggaaatgggggtgcagcccagccaccccccattcgggtactcaatctcaggtgtccacaagttctgcccacggtaggggctgcctggccccccagacctcgggggtagagccaggagtggggcagcgttaggatgcccggaggggctccaggtgttgcttctgagacctgggatggggagggaggggacctctgggttcttccaaagaacatttgactcagtggggtcgggagggaatcctggcttatttattttcctctgtcctcgggtgtgggggccctagctcgccctctctgggtgggtgggtgagagaggctgcaggggaggctggcaccgggcttgggcctccagtccctgccttgctgactttggccgttgcggtatcacgtgacaatcaactctcccttaacgacgactgcggctgttgggctgcgctgccctccctggcctgcaggtggggccgtggagcccatgcccgccggggttgcaggctcttccgggcctgggctgcagcctggcccggccctgcttccctggcctcccctccttctcctgggtgcttggaagaggtgggtcctggcccgtggttgaggtcttgcctcgtggactggaagcagagggctggctgtgcagcctcctggggtagctcgttttttttgcaccgggtagaatattttttcaggcacggattcctttttttctgggcccccatgggtggtccggcatcctcagggggtgtgagtgtgtgtggggggtctctgagctgaacttgggtggggtggggacttgttcctcgggggccacctttgtgtccttgtcagcggtcgtcctgctgtggcctgggttgcatttcctcttggggggggtattgaggacccccagcctggaatgagaagggtccccggttccatgtcagacccagaaaggtggatccccccactgttggctgcaggaggtttttggtacccccttttgttccagaaccgtcctgcctctcgcttggggacaggggggctttggatggcactggtgtgcacctggacccagccccggcctggcaggatccagggatgggtgcctgggatcctggggggagggaggcaggggacgcccttctggagctgggctcggagggtcctgccccatccagccctcggctctctgtgttctctgtccctagcctcaaaccctcttctggcagcgctagtgagatgccttagtctgtgggggtgggtgggggactggggccccgttttcctttgtgagtcttggttggccccagccctggcaggggcctgtctggagcaggggtaggtagggctgtgggttccagaactctataactgggcccctctccagtgtccaggggcttggagagacctgcgcccacccctccactctcccaggagtcgctgatcactgggacctggttccagccgtttgcaggggaggcggctccgagaggcgtgtgctttccgtgggtggcgcccctcccccgccctgcctggcctcatccttgtatttaattaattaaacaagcccctttttaaaccctaaaaaaaaaaagaaaaaaacacagcagcggagcgacagaagcaggtaaaagaacagagaggaaagacgaggaggacaggacagaagagagaagagaagaagaagacacgatgacaaagaggaacagcagagacaacacacaaagaaggagagaagag

SEQ ID NO: 302507 - DNA, 1791 bp, Homo sapiens
cgccggccggacggacgccgctcccgccgcctccgctccgcccgccgcgccgcgcgcccttgctcggcatgtcggcggccgtggcgtgcgtggattacttcgccgccgacgtgctcatggccatctcttcgggcgccgtggtgcaccgcgggcggcccggccccgagggcgcgggccccgccgccggcctggatgtgcgcgcggcgcgccgcgaggccgcctcacccgggaccccggggccacccccgccgccccccgccgcttctggcccgggccccggcgccgccgcggcgccccacctgctggccgccagcatcctggccgacctgcgcggcggacccggagccgccccggggggcgcctcgcccgcctcctcctcctcagccgcctcgtccccgtcctcgggccgcgcccccggcgccgcgccctccgccgccgccaagagccaccgctgtcccttcccggactgcgccaaagcctactacaagtcctcgcacctaaagtcgcacctgcggacgcacacaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggagggggcctgagactggacctgggtctgcctgacctcagaggtggctctcaggatgggtgacggggggcttgtgtctgtaaatagccatgatactaactttcttcccatctgtgcaacggggcccccccagggcagctaggaggtcctcccctctcctctccaccaccccgtgctgcccccctcccggggtggggtttgggggggtggagtggacttctgggagccggcccggggaaagcaccccctgccccatccctgcagattgggatgaagtgttcagacagccatagaggagtcgggggttgacacggcccctgcctctccccaccccaccccaccccaccgaaagccatgggagtagttcagggaaatgggggtgcagcccagccaccccccattcgggtactcaatctcaggtgtccacaagttctgcccacggtaggggctgcctggccccccagacctcgggggtagagccaggagtggggcagcgttaggatgcccggaggggctccaggtgttgcttctgagacctgggatggggagggaggggacctctgggttcttccaaagaacatttgactcagtggggtcgggagggaatcctggcttatttattttcctctcagtgtccaggggcttggagagacctgcgcccacccctccactctcccaggagtcgctgatcactgggacctggttccagccgtttgcaggggaggcggctccgagaggcgtgtgctttccgtgggtggcgcccctcccccgccctgcctggcctcatccttgtatttaattaattaaacaagcccctttttaaacccta

SEQ ID NO: 302508 - DNA, 2916 bp, Homo sapiens
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcagaacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 302509 - DNA, 2820 bp, Homo sapiens
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcagaacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 302510 - DNA, 404 bp, Homo sapiens
  misc_feature (331)..(331): n is a, c, g, or t
  misc_feature (355)..(356): n is a, c, g, or t
gcaacctcccagacaagccaaacctgagatgaggaggccaataagggttttctggacaggggagacgcacctccaggaattgagtgcccagaaagaccaagaggctttctagggggtgggactgcttgggcaaagtcttgggggctagtgggcggggtactggacactgtgacttgagtggtacccccttcgctgaggcctgtggttttggccaccacttttctttgacagctgggcttcctgtataccctcatcccagtgtcttcctccctcaggactcgccacactcacccaccctccttctcatttttcagcacatggcccttcatcntctacccttcctctattttattannaccattccacccctcaattccttacccgttccttcattctttccatct

SEQ ID NO: 302511 - DNA, 3015 bp, Homo sapiens
gccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcagaacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 302512 - DNA, 3355 bp, Homo sapiens
gccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagcccagcttgaggactgggatggctgggcaaggaagccataggcattgcggccccttgccttggtgcagatgtgagtcccacaaacacatctggagaagctcaaaggccgggactgggagatgactcccttggaagacaggagagatgactcccttggaagacagatgacagcccataggcctagtgacaaaaggcccctttccgaccttgtggctgttctgggaactgcacctgtcctaggtctgggccagaccaagcagaatggcagtctgaggacactgacttaccacccaagtcccaggaagagaggacaaggaatcagccaggcctgtgcaaaggcagcattttttggttgtggagtatgactatgaattcaccctctgtttacagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcagaacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 302513 - DNA, 3023 bp, Homo sapiens
gccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagatgggatccctgcctgtaccatcctgagcccttaatctgaaaaagcaaggtgacaacaacacagaaccatctggttgccaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcagaacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 302514 - DNA, 2084 bp, Homo sapiens
gccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcagaacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgccttatacaacctttgcctattatagtaaatcattcaaggattcataatttggcaaggacagaaaagtgtatttattttgtttaatgaatgaggggacctgctatccgcccttaatgtaggtttggcccaagagtcctccatttt

SEQ ID NO: 302515 - DNA, 1333 bp, Homo sapiens
gccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgtgagtgcctagtgacacacagcaggggtgggcaggggaccctttgagataccatgccccaggccacaatctcagtaaggaacgcagaactactgtcctgaaggcaccgatgaggaagggcacggagggtccaaggcctcccatggctgcctcagaagaggacaagcccacatcctattctccactccagaatatgctcacacatgagctgttacccaacatttgattgggccacatgggcagaaggggagaaaggggtctggaagtcacctccttccattcaaactggagaccagattggggtgagggaagagcttctaaatgcactccatagcagcctagcaagaccagcaatcaagaaacaccagcaccccaaggtaggaggggcctgtacgcccagaatcccagggttacccaagctaggcagcaggctgtgggtatcccaatgtct

SEQ ID NO: 302516 - DNA, 161 bp, Homo sapiens
tgggatcttaaggcccctgtaggaggttctaggatgcagtaactgctgatatggcctgccaggtcaggctagcccactcactcagcttctctcctctgcagttcacaggcctctgcagacccctgacctctctggcttctactccctgacctcaggcagca

SEQ ID NO: 302517 - DNA, 422 bp, Homo sapiens
ccctctggcatggctgtgagcagaccctggctcgcctaagaaatgccgtgctcgctttggcctcaaccagcagacggattggtgtggtccgtgcaggtgggtttgtccccaccatcgttctccctttgctttaagctgcttccctgactctgcacatgttccactgggcctgcagcccactcctttggcccctcagcccactagcatactcagcagattgggagcccaggcctcctgagaatagtagtaaatactgaacacagcgcgtggagaagaccacttgggtctaagtgcaggaggattggagagaaagacacagaatgttccagaaaggaaggacagactcaagaaggcagctctgatgccagtgggcctagcaggtcctcagcaaacagacagctcagccaccactaagggggcct

SEQ ID NO: 302518 - DNA, 327 bp, Homo sapiens
tgctcgccctctgccctgctctacccctctggcatggctgtgagcagaccctggctcgcctaagaaatgccgtgctcgctttggcctcaaccagcagacggattggtgtggtccgtgcaggtgggtttgtccccaccatcgttctccctttgctttaagctgcttccctgactctgcacatgttccactgggcctgcagcccactcctttggcccctcagcccactagcatactcagcagattgggagcccaggcctcctgagaatagtagtaaatactgaacacagcgcgtggagaagaccacttgggtctaagtgcaggaggatt

SEQ ID NO: 302519 - DNA, 2965 bp, Homo sapiens
gccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcagaacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 302520 - DNA, 3303 bp, Homo sapiens
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagagacaaactggcccagagaactcaaggatggtaatggacaagagtcactgtccatgtcttcttcctctagcccagcttgaggactgggatggctgggcaaggaagccataggcattgcggccccttgccttggtgcagatgtgagtcccacaaacacatctggagaagctcaaaggccgggactgggagatgactcccttggaagacaggagagatgactcccttggaagacagatgacagcccataggcctagtgacaaaaggcccctttccgaccttgtggctgttctgggaactgcacctgtcctaggtctgggccagaccaagcagaatggcagtctgaggacactgacttaccacccaagtcccaggaagagaggacaaggaatcagccaggcctgtgcaaaggcagcattttttggttgtggagtatgactatgaattcaccctctgtttacagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcagaacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 302521 - DNA, 3372 bp, Homo sapiens
gcaacctcccagacaagccaaacctgagatgaggaggccaataagggttttctggacaggggagacgcacctccaggaattgagtgcccagaaagaccaagaggctttctagggggtgggactgcttgggcaaagtcttgggggctagtgggcggggtactggacactgtgacttgagtggtacccccttcgctgaggcctgtggttttggccaccacttttctttgacagctgggcttcctgtataccctcatcccagtgtcttcctccctcaggactcgccacactcacccaccctccttctcatttttcagcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagcccagcttgaggactgggatggctgggcaaggaagccataggcattgcggccccttgccttggtgcagatgtgagtcccacaaacacatctggagaagctcaaaggccgggactgggagatgactcccttggaagacaggagagatgactcccttggaagacagatgacagcccataggcctagtgacaaaaggcccctttccgaccttgtggctgttctgggaactgcacctgtcctaggtctgggccagaccaagcagaatggcagtctgaggacactgacttaccacccaagtcccaggaagagaggacaaggaatcagccaggcctgtgcaaaggcagcattttttggttgtggagtatgactatgaattcaccctctgtttacagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcagaacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 302522 - DNA, 1977 bp, Homo sapiens
gccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcagaacttctgcctgaacctggggtcatcgattcaaactgctccaagtggtgggaatcagaatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 302523 - DNA, 1426 bp, Homo sapiens
gccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggcccagccctcctctctaccccctgtccccttcctgcggatatagacagcacttccctgcccccactgcagcccctggcgccccctaccccaggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgtgagtgcctagtgacacacagcaggggtgggcaggggaccctttgagataccatgccccaggccacaatctcagtaaggaacgcagaactactgtcctgaaggcaccgatgaggaagggcacggagggtccaaggcctcccatggctgcctcagaagaggacaagcccacatcctattctccactccagaatatgctcacacatgagctgttacccaacatttgattgggccacatgggcagaaggggagaaaggggtctggaagtcacctccttccattcaaactggagaccagattggggtgagggaagagcttctaaatgcactccatagcagcctagcaagaccagcaatcaagaaacaccagcaccccaaggtaggaggggcctgtacgcccagaatcccagggttacccaagctaggcagcaggctgtgggtatcccaatgtct

SEQ ID NO: 302524 - DNA, 963 bp, Homo sapiens
tgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgtgtgtgatgggaatgagccacctcagatgtggagggccctgaagaatccaacgcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctc

SEQ ID NO: 302525 - DNA, 720 bp, Homo sapiens
tacggctggagaagacgacagaagggggcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctc

SEQ ID NO: 302526 - DNA, 308 bp, Homo sapiens
atgattagaacaaactgattaaatggcactgtcttctgcccaggtgaaatagactgaagtcacgctaacttttctcagttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctc

SEQ ID NO: 302527 - DNA, 691 bp, Homo sapiens
taaaaatccaacatgtaccttccagctgtctacaacacaagtgcatgctcgtcggacaagaggtcacagctaaggcaacaatccacatgagttgggaagggctcatttcacctgtcaaacactgctgctctcatgtggaatgcactgtggctttttggtcaagataattaccgtggaagatcctaggtggcagcaaatcccaggtgaacagactgagccgtggaggtggcataaggcaaccctagccgagtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgtaagtgatgatcatagtccttgtcctataatgttgattttaggaagagaaattggatgggactggttttgatcatggttggccaggctcccatactgctattgacatttgcagaattttccattggtctgcaaagtatgcattaatatcatcataattcatcagtgctactgctcttggtcattgccttgtctttctgttcttcaaatcattaaggtaatagaaaattaatgtttgtagctagtacaataatttctgtaccaata

SEQ ID NO: 302528 - DNA, 1469 bp, Homo sapiens
tacggctggagaagacgacagaagggggcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggggggaatcccgggcgagccgacaccaaactagacaataccagccctgttttttataaagacaggcaggcgccccacataagcgcggccataaattaacaacacgagccggacgcggcgtacaacaacgaggcgtgaagtagagagagacagcactgcttggttacgagcaattagagagcaacccacccccgccgtggggggagggaacataactgtagaccaaccaaccaccaaaaagataagtttccctcgaggcagaaaaacaacacgcgacgtaggatggctgaaacccccccgttttctgtggctcggtggcagaaaatgtcgctcgcgtgccgtctctctttaatcatactcttcacgggggcggtgagagagtacgaacacgggcaggaacggtagacgaaccgaaggccagcaacagcacaagtagtaagcgtcaaacagcaccgaaccgaggacgaccagcacgacacaacacaacgacagccgcagccgacagcaccctacgacgccaccgagccacgaacgcgcaccacaacgaccaaccagaccaagacaggcacaccaaaagcaccgcaggcagccagacgtccacagaccgaccactgacaggatgcagggcccccc

SEQ ID NO: 302529 - DNA, 983 bp, Homo sapiens
  misc_feature (836)..(836): n is a, c, g, or t
tacggctggagaagacgacagaagggggcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaacctggggtttttttttttttttttatttaaaaaggggcggtttttttttgggaaattttaaaaataaatttggaataaaaattggacccaaaaggtttggggtgggcccttttttgggataaacccaaaaaaaaagttta

SEQ ID NO: 302530 - DNA, 1496 bp, Homo sapiens
  misc_feature (15)..(15): n is a, c, g, or t
  misc_feature (30)..(30): n is a, c, g, or t
  misc_feature (33)..(34): n is a, c, g, or t
  misc_feature (36)..(36): n is a, c, g, or t
tgcggatcccccaancgcagagaggatacnaanntntaaatcacaaatttagtagaagtggcagctgacagggacaaacccgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggggggaatcccgggcgagccgacaccaaactagacaataccagccctgttttttataaagacaggcaggcgccccacataagcgcggccataaattaacaacacgagccggacgcggcgtacaacaacgaggcgtgaagtagagagagacagcactgcttggttacgagcaattagagagcaacccacccccgccgtggggggagggaacataactgtagaccaaccaaccaccaaaaagataagtttccctcgaggcagaaaaacaacacgcgacgtaggatggctgaaacccccccgttttctgtggctcggtggcagaaaatgtcgctcgcgtgccgtctctctttaatcatactcttcacgggggcggtgagagagtacgaacacgggcaggaacggtagacgaaccgaaggccagcaacagcacaagtagtaagcgtcaaacagcaccgaaccgaggacgaccagcacgacacaacacaacgacagccgcagccgacagcaccctacgacgccaccgagccacgaacgcgcaccacaacgaccaaccagaccaagacaggcacaccaaaagcaccgcaggcagccagacgtccacagaccgaccactgacaggatgcagggcccccc

SEQ ID NO: 302531 - DNA, 999 bp, Homo sapiens
tacggctggagaagacgacagaagggggcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctcaaaaaaaaaaaaaagggggcgccaaaaaatcctcgggggcccagttaggtaccagcttctgacaagggcctagggaggcgataaagcaagccggcgcgttaacgtcggtggcaccgcggttggcacttgggcaggaccaccctgcggccccacggcacacccgggataggcgggatatactcacggtaggtcacacgatctgggtgatggtcgtatgaccaccgagaggaggggggaggaaaagacagcacacagcagagcagcaagcaccacaacacg

SEQ ID NO: 302532 - DNA, 808 bp, Homo sapiens
tacggctggagaagacgacagaagggggcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctctaaataattattatagtatctgcctctcaatattactcattcgcctcccgccaccctcgcacatccccggggaaataaatataataaa

SEQ ID NO: 302533 - DNA, 973 bp, Homo sapiens
  misc_feature (914)..(914): n is a, c, g, or t
tgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgtgtgtgatgggaatgagccacctcagatgtggagggccctgaagaatccaacgcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagtccagcctctgcctttcattaaatgtaaccttttgccttccaaattaaagaactccatgccactcctcaaatngacctaataggaggctcatgaccattcattggcgggcggtttacaacgtccattatggg

SEQ ID NO: 302534 - DNA, 1049 bp, Homo sapiens
tgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgtgtgtgatgggaatgagccacctcagatgtggagggccctgaagaatccaacgcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatatgaggaactgaagttgagagagcctggctaggatggctgagcacggtggctgatgcctgtaatcccagcattttgggaggccgaggttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctc

SEQ ID NO: 302535 - DNA, 789 bp, Homo sapiens
tacggctggagaagacgacagaagggggcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggcctggaccctttgttgttgcctcaagtgcatccccatctaggtataattagaaacctttaaatcagcagtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctc

SEQ ID NO: 302536 - DNA, 631 bp, Homo sapiens
tacggctggagaagacgacagaagggggcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcatttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctc

SEQ ID NO: 302537 - DNA, 656 bp, Homo sapiens
taaaaatccaacatgtaccttccagctgtctacaacacaagtgcatgctcgtcggacaagaggtcacagctaaggcaacaatccacatgagttgggaagggctcatttcacctgtcaaacactgctgctctcatgtggaatgcactgtggctttttggtcaagataattaccgtggaagatcctaggtggcagcaaatcccaggtgaacagactgagccgtggaggtggcataaggcaaccctagccgagtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctc

SEQ ID NO: 302538 - DNA, 429 bp, Homo sapiens
tggcttaccagattctgtaagtgtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctc

SEQ ID NO: 302539 - DNA, 1405 bp, Homo sapiens
taaaaatccaacatgtaccttccagctgtctacaacacaagtgcatgctcgtcggacaagaggtcacagctaaggcaacaatccacatgagttgggaagggctcatttcacctgtcaaacactgctgctctcatgtggaatgcactgtggctttttggtcaagataattaccgtggaagatcctaggtggcagcaaatcccaggtgaacagactgagccgtggaggtggcataaggcaaccctagccgagtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggggggaatcccgggcgagccgacaccaaactagacaataccagccctgttttttataaagacaggcaggcgccccacataagcgcggccataaattaacaacacgagccggacgcggcgtacaacaacgaggcgtgaagtagagagagacagcactgcttggttacgagcaattagagagcaacccacccccgccgtggggggagggaacataactgtagaccaaccaaccaccaaaaagataagtttccctcgaggcagaaaaacaacacgcgacgtaggatggctgaaacccccccgttttctgtggctcggtggcagaaaatgtcgctcgcgtgccgtctctctttaatcatactcttcacgggggcggtgagagagtacgaacacgggcaggaacggtagacgaaccgaaggccagcaacagcacaagtagtaagcgtcaaacagcaccgaaccgaggacgaccagcacgacacaacacaacgacagccgcagccgacagcaccctacgacgccaccgagccacgaacgcgcaccacaacgaccaaccagaccaagacaggcacaccaaaagcaccgcaggcagccagacgtccacagaccgaccactgacaggatgcagggcccccc

SEQ ID NO: 302540 - DNA, 790 bp, Homo sapiens
tacggctggagaagacgacagaagggggcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcatttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctctaaaaaaaaaaaaaaatgaaaaaaaatttgtggggcggttggcctggaaaagttttaaacccttggtggggggggcccgttgttaatggaatggcaaggtgtcaaggaatcggcggaaaagggtgggtttcccaaaaaaggcggggacggggttgacat

SEQ ID NO: 302541 - DNA, 545 bp, Homo sapiens
tacggctggagaagacgacagaagggggcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcgggttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctc

SEQ ID NO: 302542 - DNA, 1193 bp, Homo sapiens
ggctgaaagtccaaaatctctcctttaagttctgatgccagaatctccaggttacttacttgacccaatataccaaataaggtagtgccctttttcctcctggggcagcccggttcttctgaaaggtagtatttcccagcctcttttgagtcatggtacacgtaggagattgcagtatttttatggcacactgggaaaatcagttgcttatagctggagacattggagcccctaaggctggaggtcactttccaaccagagctgtgctggagtccagtaggtgggaggctgtgctttgagggactaaaggaagcctgtatcttgtggtgagggttccacctcacaagttacagatctcagttccatttggctctagcagcaatgtggccacttctgttgcggttactctttcttcacctttttcttgccaaaaataaacttatctttaaatgaaaactaaattatttcttatattttggtcctttgttatagctgagattgggaatttttctttctttcttgaatccttacttccctaccctgcctccccaccaatggaaatctgtgcttcataagcattttagattccagaaagctctttaggttaaactacaaccctctcacctcaaagaatttgtgggccagggaagtcagtgacttatgtgaagtcttgcggctaattaatggtagagctggagttaggacacatgtctcacagttcctagttcgtttgctttgatgtgcttgaaattcagttttgacattaatttttctggatactactcccataaaatgttctttgaaaaatacttgcttctttctagtttttctcgcctggtttaaatattgtcctgagtgtgggaaccccataactgtcttgtgggttagaatttagatggaaggatttggggccctgtctctagtatcataagacatttaaccttgctgcttttttcttctaggttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctc

SEQ ID NO: 302543 - DNA, 911 bp, Homo sapiens
tacggctggagaagacgacagaagggggcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcgggttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctcaaaaaaaaaaaaggagaaagaaaacaaaaagagaactcaagcgagcaaacaggcaaaaaaacaggccagcggagccgaacaacaggaaaacaaaagaccagcaacgacgcgatggccgaacacaccgagcagcggaagaaccaggcagaaaacgaaaacagatgagcgcccaacagacgatgtgacgccaggccaggatggaggacacacgaggggcggccgcggccactagaagacatgagtaggaaggcagacataaagggcgcagaaaaaaggcacgcgagagatagaagtgtaggcggaacgagccgcagtgccaggggaaagaggaagagacggagggaagaaagataacgagaggagaga

SEQ ID NO: 302544 - DNA, 387 bp, Homo sapiens
tacggctggagaagacgacagaagggggcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcgggtaatggttctataagtgatcataataataatgtgttactttggtgtgctgcttttgttttcatagtactcta

SEQ ID NO: 302545 - DNA, 1076 bp, Homo sapiens
gcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatct

SEQ ID NO: 302546 - DNA, 365 bp, Homo sapiens
ttctatgcgatcaggtgcgtgtagaacctcatcagcctgaataaccggaacgtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatct

SEQ ID NO: 302547 - DNA, 387 bp, Homo sapiens
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggctctcaagagtaaccagagactctgaagaagtttaaaagttatgaccctacgtagaggacagataaggatctaggacctaagagcatggtcccctttcctaccccctgggtgcatcctagagagggcatatagcagagatagccctacatccatcacagacagacccgtagactgg

SEQ ID NO: 302548 - DNA, 1036 bp, Homo sapiens
tgcgaggacagctggggagaaggggagctgtgactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatct

SEQ ID NO: 302549 - DNA, 952 bp, Homo sapiens
  misc_feature (17)..(17): n is a, c, g, or t
ttggtgggcatctagangatccttcccgggtctgggtaggaagtcctcatcgctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatct

SEQ ID NO: 302550 - DNA, 1019 bp, Homo sapiens
gcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatct

SEQ ID NO: 302551 - DNA, 1457 bp, Homo sapiens
gcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctaagcaacccctaggggttgcttggttgagtagagctgcctctcagaggcagcatgagctgagagggtgataggaaggcggcgctagacagcatggaggactttctgctctccaatgggtaccagctgggcaagaccattggggaagggacctactcaaaagtcaaagaagcattttccaaaaaacaccaaagaaaagtggcaattaaagttatagacaagatgggagggccagaaggtgagccggggcccctttggagggaaggagggaggactggctgaggtgggtgggtgcttcctcctgtttgttagaacgatcattcgatcattctgctcccgctggcctgaaccaacaaccctggtccacgagttcgattcactgc

SEQ ID NO: 302552 - DNA, 604 bp, Homo sapiens
gcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatct

SEQ ID NO: 302553 - DNA, 955 bp, Homo sapiens
gcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcccccacccatctgggccccgggttcaagagagagcggggtctgatctcgtgtagccatatagagtttgcttctgagtgtctgctttgtttagtagaggtgggcaggaggagctgaggggctggggctggggtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatct

SEQ ID NO: 302554 - DNA, 1152 bp, Homo sapiens
caatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatct

SEQ ID NO: 302555 - DNA, 1197 bp, Homo sapiens
ctctgagagcattgatgaggtcaggaagcctcctgttgggtagaggagcaactaagagactgaacttggcccccaccctgaggctcacaagcttgaattgcacctgagttccaaaggagaagttgacattcttccagaacatatgcccagtgtcttcaacttgagatggagctgggatgccaagtctgcaaatactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatct

SEQ ID NO: 302556 - DNA, 933 bp, Homo sapiens
tgcgaggacagctggggagaaggggagctgtggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatct

SEQ ID NO: 302557 - DNA, 1164 bp, Homo sapiens
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatct

SEQ ID NO: 302558 - DNA, 1586 bp, Homo sapiens
  misc_feature (1568)..(1568): n is a, c, g, or t
agacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggtaagacacacagctctttcctcaaatgcaatgggggaaatgtttttagcccatctcaatggatacttccccatcttgtcatgtcacccaggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttacccccttaggtgttaantccagaagggatgtaagt

SEQ ID NO: 302559 - DNA, 1541 bp, Homo sapiens
agacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtgattctgcaa

SEQ ID NO: 302560 - DNA, 922 bp, Homo sapiens
agacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaaggtataaaggattttcctcccagagcatgcagtgtggttaaaaactgtgcatcaaatctcacctgcttctaaaaattcacgtttctggtatccatcattatgggattttaactggtcctacttcagaagttagatttgggagaaaaattatttttaaaaaatggttttttttgcaacaatgtgaatacacttaacacttaaaaatagttcagatgctaaatattatgatatgtg

SEQ ID NO: 302561 - DNA, 1576 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatct

SEQ ID NO: 302562 - DNA, 1760 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtggtgagtgtgtgcggtgttgcacttggggttgcttctcgctgcgtggccgcagcggggctgaacccttcccactccatcccctccccgcacccggaccagcccctgggacgccctcggacgcccacccgctccaaccctggggaagcctcagagtggcagcgaaggcctcttgcctttccgcctctgcgcttgctgtcatcgcccacgtgctttgttgttgttcggtgcagaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttg

SEQ ID NO: 302563 - DNA, 2343 bp, Homo sapiens
gcgtcattcctcttggatatagatgttttcctggacacaccagctacacaataagccagtaaatctaagtttgacctgcttgttattattgggagccctaggtatgtcaaaggcttttcaccaagccagggttattaatcaaagctgactccctcgtattgatcagacctcaaatggtcgtgttccatgccaccctgtttatatattgctgtttaatttgcagccaccctgcgtgcactctatctaagtgacaacgattttgaaatcctgccgccagatattgggaagctcacaaagttgcagatagtaagtaatttatctaaattcttagaaaatcaattcactgctgcagccttgtaggggtagaatcaagtcaatttgagcaggagtaaggtttgttttgtgggaataaaccactactcctgatagtgtttcttgattatccgccggcacttgtaaatacatggaaaggattgagctttagtagaagagaggacatagaggatgagagtttctgtggagcaccttttaatgtgtaaatatgttgacaacttgttttcttctgtttagctcagccttagggataacgacctgatctcgctgcctaaggaaatcggggagcttacccagcttaaagagctccacattcaggggaaccgcctcaccgttctgcccccagaactaggtaaggttgctgatgaatgaacttagttctgggtttcatgaataacaattatcctaatgtagcaattctgaacaacctctgtcctcttcttggcaactactctccacctaggcacacgatgctgatcatttgagaaccatttgtcattgaccagagttagctgttacaggtttgaccttcccggatcctgtgttctgcagctgtagtgtcccctgtcttagaaactgctgatgaaagatgaccccgctcagctccctgcgtgatgtagtgggaaaagcatgggattagtagtaagagccttatccctggctcctcattgactagctgggtaagctttctgggtcttggttggttattaataactttaagtatcactcttactttttaaccccttaaatttttattgacctggaaaaacttttaccaaatagttaaagtagttgttatggctacttgaacatgttgatacctctgcgggtcgtgaatttgcctctctcctgatcccatctctagtaggaattgttaaatatgttcttgctgggaatggatcctactcctggccgctgaatcctaatcctgtttctctgccaggtcgttcctatttccagggtgggtttatgtcccccgccagaaataacctccaagccagtaattctgttactgcttcgttccactgcaaaaggttcacgagttcccttatcttttcttgtgcagaccctccatagcctctcatttcttcagtcctttgaaccacattgttttctcaaactgcgattatttgcttttctactccaaaataccatcatttttaagaaacacattgaggaagcagttctttaaacaagtttggcagtttgaagaggccatttgttagaaattagaatgcaatcaccaggagggcagggacatttttgtatttgttccctcgggtacagtaggtgctcagaaaacactgactgaatgaattaatgaagcaaggaccttggatgacaggacgttaggaaggttatgagcaggctcatgtggctaatggttacgcataggaagactgagacacagagcacgcctatcagcaccttgagttctgttggcagccatattagtctaaagggaaggcagtcacgtgatttcgtggaccagctgggaagtcccgcctcctctcttgccatttcccttagctctcttgctagtgttaaaaatccacctagaggattatttaatgattttttaagggctgaggagcaactcaacacttctctttactgagttgcaagtagtcacgtgttgctttgggagcagggtgacagaatcaagaaacgctttttgcaaacattttcaaggcaaaaaacttcttgttaaaggagagatctcgggccgggcacggtggctcccagttgtaatcccagcactttgggaggccgaagcaggcggatagcttgagcccaggagtctgagaccagcctgtgcaacatggtgaaaccccgtctctacaaaaagtacaaaaaattagctggacgtggtggtgcatgcctgtagtcccagctactcgggaggctgaggtgggaggatcacctgagcctgggaggtcaaagctgcagtgagcagtgatcgtgccactgcactcctggctgggtgacagaacaagaccttgttgaaag

SEQ ID NO: 302564 - DNA, 3838 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaaaatcaattggt

SEQ ID NO: 302565 - DNA, 1530 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttg

SEQ ID NO: 302566 - DNA, 1991 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgaaaaaaaaaaacaaaaaaaaaaaacaaaaaaaaaaaaaaacaaaacaaaacaaaaaaacaaaaaaaaaagggggggggcgcgcggggcggcccacagaagaaaagagttctaaacagaccaccggcgggggaggcgcgcgcggggagaccacagtgagaaagagaggaacaccgagggcacacagaagaggtgtatacaagagaggaagaaccggcgggcaagaacaacaagggggggaggggaaattcccacacacaagagaaaaaaaaaccgccccgcggcggggagagaaacacgagagcgatggtcagacaaaaaaaaaacaacaaaacaaacgagggagtacctcaggaggagcacgtccatcagcggagaggagcaatacaccaacggagaggggcagccaccaaaggaacaggacgccggcgaaagcatacgaataatacacccccccggagtg

SEQ ID NO: 302567 - DNA, 4068 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtggtgagtgtgtgcggtgttgcacttggggttgcttctcgctgcgtggccgcagcggggctgaacccttcccactccatcccctccccgcacccggaccagcccctgggacgccctcggacgcccacccgctccaaccctggggaagcctcagagtggcagcgaaggcctcttgcctttccgcctctgcgcttgctgtcatcgcccacgtgctttgttgttgttcggtgcagaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaaaatcaattggt

SEQ ID NO: 302568 - DNA, 3717 bp, Homo sapiens
  misc_feature (162)..(162): n is a, c, g, or t
agagagcttctgcttagtaccagttcgttgggggcgcgggcccagtcatgtaagtgaactatggttcctatgctgttgtctaagatatcctggacatagctagtgcgttgagatctcaccaatacaaaacgcccgtggggatagacgtaaccgttctgaatntaacatccatgatggagtgcttgacggtccatctacttggcatcttatccaatatggagtccactgggacgctcgatcattaacttactccccgtggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaaaatcaattggt

SEQ ID NO: 302569 - DNA, 3734 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcagcctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaaaatcaattggt

SEQ ID NO: 302570 - DNA, 2936 bp, Homo sapiens
  misc_feature (59)..(59): n is a, c, g, or t
agagtgtacccaagccgggaggccgtgcgacggggaaaagaaagctactcctaccgcgnaccgtgctggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaaaatcaattggt

SEQ ID NO: 302571 - DNA, 2886 bp, Homo sapiens
cccctatccacttctctctctcgtcgctaccaacaccaccctctacactgcaattgacctgaaggatgccttctttaccatttccctacaccctgattcccaaaacctatttgctttcacctggactgagcctgacaccctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaaaatcaattggt

SEQ ID NO: 302572 - DNA, 2473 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggtaaggttgctgatgaatgaacttagttctgggtttcatgaataacaattatcctaatgtagcaattctgaacaacctctgtcctcttcttggcaactactctccacctaggcacacgatgctgatcatttgagaaccatttgtcattgaccagagttagctgttacaggtttgaccttcccggatcctgtgttctgcagctgtagtgtcccctgtcttagaaactgctgatgaaagatgaccccgctcagctccctgcgtgatgtagtgggaaaagcatgggattagtagtaagagccttatccctggctcctcattgactagctgggtaagctttctgggtcttggttggttattaataactttaagtatcactcttactttttaaccccttaaatttttattgacctggaaaaacttttaccaaatagttaaagtagttgttatggctacttgaacatgttgatacctctgcgggtcgtgaatttgcctctctcctgatcccatctctagtaggaattgttaaatatgttcttgctgggaatggatcctactcctggccgctgaatcctaatcctgtttctctgccaggtcgttcctatttccagggtgggtttatgtcccccgccagaaataacctccaagccagtaattctgttactgcttcgttccactgcaaaaggttcacgagttcccttatcttttcttgtgcagaccctccatagcctctcatttcttcagtcctttgaaccacattgttttctcaaactgcgattatttgcttttctactccaaaataccatcatttttaagaaacacattgaggaagcagttctttaaacaagtttggcagtttgaagaggccatttgttagaaattagaatgcaatcaccaggagggcagggacatttttgtatttgttccctcgggtacagtaggtgctcagaaaacactgactgaatgaattaatgaagcaaggaccttggatgacaggacgttaggaaggttatgagcaggctcatgtggctaatggttacgcataggaagactgagacacagagcacgcctatcagcaccttgagttctgttggcagccatattagtctaaagggaaggcagtcacgtgatttcgtggaccagctgggaagtcccgcctcctctcttgccatttcccttagctctcttgctagtgttaaaaatccacctagaggattatttaatgattttttaagggctgaggagcaactcaacacttctctttactgagttgcaagtagtcacgtgttgctttgggagcagggtgacagaatcaagaaacgctttttgcaaacattttcaaggcaaaaaacttcttgttaaaggagagatctcgggccgggcacggtggctcccagttgtaatcccagcactttgggaggccgaagcaggcggatagcttgagcccaggagtctgagaccagcctgtgcaacatggtgaaaccccgtctctacaaaaagtacaaaaaattagctggacgtggtggtgcatgcctgtagtcccagctactcgggaggctgaggtgggaggatcacctgagcctgggaggtcaaagctgcagtgagcagtgatcgtgccactgcactcctggctgggtgacagaacaagaccttgttgaaag

SEQ ID NO: 302573 - DNA, 424 bp, Homo sapiens
accatgtccaagtctctgaagaagttggtggaggagagccgggagaagaaccagcccgaggtggacatgagtgaccggggcatctccaacatgctggatgtcaacggcctctgtgagttctcgggcaggactctcccgtggatgagctggaaggctttctaagtttgccaattcactgctggtcctgctgtgagcgattgtactggtttagaccccagcccctgcttgtaaacctcacttgtcaggggcttcgcgcagagggtttgcagtaggatttgttctgttccacctggaaaacgatcctgagagtccacgatgagaatcacacagacagctgtgcctcatcggttgtctctgctgtatggcattgaggtggattttccacagtttgcttaatagtcactttaattataaattgaaaatt

SEQ ID NO: 302574 - DNA, 4451 bp, Homo sapiens
gaattccgttttttttttttgacgtgacatctctttattggttcagtctatgcctggcccagcggcacgcccaggtccagggggggtctggttggaggtctctggacagtcaggggcagcatcagcagaaaccctgggtgtcggggggctgtgggagtagcagcactggtccccgcgttgacaggtgccctccttaaacctcttgcaaggaaatgtcttgagccgggcagcccgctggcaacatcttccggcggctccttccgcttgttctgaagcagcctgcgtctctcctccatagcttcgtcggccgccttgcccctgtgcgaggggaggagtaggtgggaccccatctgccctttaccccttctttccctggctgagccccacccccaccttaccaccactcaccctggccgggcacgaggccggggaccccagttggcctccgggttagcctggaagcgcttgagtcctcgctgtcgggagctggggttggcatcttcccggatggtgaagttggcctgcagcctgggctccacactgagaatgcggaacgctgggctagtctctgatagtcgctcccgtttcaccggacattccttctcccagcaacgcatgatgtcccagagggcagaggcaggggcatccgtcttcacagcgttcttacaggcgtgggagagtgagacccggaagtcagcgtggaggagggccgaccgcaactgcaggaggcttggtgtgttgcagtggatggtgctgctcagcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaaaatcaattggt

SEQ ID NO: 302575 - DNA, 603 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctgaaccagagatcatgggataaatggctgattccaggactgtggcagaaaaaatacaagatgaacctgaatatcttgtgtcagaaggcaagaaagtgctgcaagaatgagggcgtgtgtcgaaaggactaataagccagcttggatggactcatactggccaaatcaggggcaatttaaccatcactgtaaataataatgatagattataacccgtcagctaaaatagcaagctgcaaagccatgcaagtataactaaataaaccatgatctcccagc

SEQ ID NO: 302576 - DNA, 3726 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaaaatcaattggt

SEQ ID NO: 302577 - DNA, 1215 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatagtaagtagactctgattttctgaaatagtagactgtgattttatagtatttataattacgcctttaaaaatattatgtgacagtatcctattgatggcagttagcacttagcattttaagatgttttattaaaaactgcatgtcggccaggtgtggtgtggctcacagctgtaatcctagcatttggggaagtcgagactagaggattgcttgagcccaggagtttgagaccagcctgggcaacatagcaagaccccgtctctacaa

SEQ ID NO: 302578 - DNA, 1887 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcagcctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgaaaaaaaaaaacaaaaaaaaaaaacaaaaaaaaaaaaaaacaaaacaaaacaaaaaaacaaaaaaaaaagggggggggcgcgcggggcggcccacagaagaaaagagttctaaacagaccaccggcgggggaggcgcgcgcggggagaccacagtgagaaagagaggaacaccgagggcacacagaagaggtgtatacaagagaggaagaaccggcgggcaagaacaacaagggggggaggggaaattcccacacacaagagaaaaaaaaaccgccccgcggcggggagagaaacacgagagcgatggtcagacaaaaaaaaaacaacaaaacaaacgagggagtacctcaggaggagcacgtccatcagcggagaggagcaatacaccaacggagaggggcagccaccaaaggaacaggacgccggcgaaagcatacgaataatacacccccccggagtg

SEQ ID NO: 302579 - DNA, 1610 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggtaaggttgctgatgaatgaacttagttctgggtttcatgaataacaattatcctaatgtagcaattctgaacaacctctgtcctcttcttggcaactactctccacctaggcacacgatgctgatcatttgagaaccatttgtcattgaccagagttagctgttacaggtttgaccttcccggatcctgtgttctgcagctgtagtgtcccctgtcttagaaactgctgatgaaagatgaccccgctcagctccctgcgtgatgtagtgggaaaagcatgggattagtagtaagagccttatccctggctcctcattgactagctgggtaagctttctgggtcttggttggttattaataactttaagtatcactcttactttttaaccccttaaatttttattgacctggaaaaacttttaccaaatagttaaagtagttgttatggctacttgaacatgttgatacctctgcgggtcgtgaatttgcctctctcctgatcccatctctagtaggaattgttaaatatgttcttgctgggaatggatcctactcctggccgctgaatcctaatcctgtttctctgccaggtcgttcctatttccagggtgggtttatgtcccccgccagaaataacctccaagccagtaattctgttactgcttcgttccactgcaaaaggttcacgagttcccttatcttttcttgtgcagaccctccatagcctctcatttcttcagggacatcagtctccatatttttaaatatcatgctcatgatatatttgtattgtt

SEQ ID NO: 302580 - DNA, 2310 bp, Homo sapiens
gattctgtgtgtgtcctcagatgctcagccgcagacctttgggagagtaaagggggcacacccacccaccttgcctccaggctctttccttcctattcctgttctatggtggggctccattgcgagacttcagattgagaaatcagatgaagtttcaagaaaaggaaactggcaggtgacagagatgggtggagggactggggaaaggctgtttactccctcctgtctagtcggcttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagagcctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcctttatccaactctcaatttttccttggtctccagtggaagggaaaagcccatgatcttcaagcagggaagccccagtgagtagctgcattcctagaaattgaagtttcagagctacacaaacactttttctgtcccaaccattccctcacagcaaagcaacaatacaggctagggatggtaatcctttaaacatacaaaaattgctcgtattataaattacccagtttagaggggaaaaaaagaaaataattattcctaaacaaatggataagtagaattaatggttgaggcaggaccctacagagtgtgggaactgctggggatctagagaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatgata

SEQ ID NO: 302581 - DNA, 1983 bp, Homo sapiens
gattctgtgtgtgtcctcagatgctcagccgcagacctttgggagagtaaagggggcacacccacccaccttgcctccaggctctttccttcctattcctgttctatggtggggctccattgcgagacttcagattgagaaatcagatgaagtttcaagaaaaggaaactggcaggtgacagagatgggtggagggactggggaaaggctgtttactccctcctgtctagtcggcttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagagcctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcctttatccaactctcaatttttccttggtctccagtggaagggaaaagcccatgatcttcaagcagggaagccccagtgagtagctgcattcctagaaattgaagtttcagagctacacaaacactttttctgtcccaaccattccctcacagcaaagcaacaatacaggctagggatggtaatcctttaaacatacaaaaattgctcgtattataaattacccagtttagaggggaaaaaaagaaaataattattcctaaacaaatggataagtagaattaatggttgaggcaggaccctacagagtgtgggaactgctggggatctagagaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagggtcccgaagatcctgagagtcacctc

SEQ ID NO: 302582 - DNA, 2115 bp, Homo sapiens
gtggcccggaggggcctgagctaaatccgcaggacctgggtaacacgaggaagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagagcctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcctttatccaactctcaatttttccttggtctccagtggaagggaaaagcccatgatcttcaagcagggaagccccagtgagtagctgcattcctagaaattgaagtttcagagctacacaaacactttttctgtcccaaccattccctcacagcaaagcaacaatacaggctagggatggtaatcctttaaacatacaaaaattgctcgtattataaattacccagtttagaggggaaaaaaagaaaataattattcctaaacaaatggataagtagaattaatggttgaggcaggaccctacagagtgtgggaactgctggggatctagagaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatgata

SEQ ID NO: 302583 - DNA, 604 bp, Homo sapiens
aagcagtggtatcaacgcagagtgcccattacggccgggggtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagagcctcatctcaagccaggcctcgagctacttcattgacgctgccacagtcaacgacagtggagagtacaggtgccagacaaacctctccaccctcagtgacccggtgcagctagaagtccatatcggtgagttgatgaaggggaagaggaaaatcaccaataaagggtgaaacaaagggtcctgaaatacttggtaagagccagagatgatattcttagagataaaagctaagatgagatgatgtgtggtcccactgaatggtatcagagttgtagtcctagctctaagtaggtcttgggcaaaatgtcaaagcctgtcagaccagtagatataggactgctgcatgcacaattccagaacgg

SEQ ID NO: 302584 - DNA, 151 bp, Homo sapiens
actctctactggtgacctcactgtttgttccaaatatctgccttagtgactgtcattttttttcatctctccacttctcctaataggtttggcagtgtcaaccatctcatcattctctccacctgggtaccaagtctctttctgcttggtg

SEQ ID NO: 302585 - DNA, 1978 bp, Homo sapiens
gattctgtgtgtgtcctcagatgctcagccgcagacctttgggagagtaaagggggcacacccacccaccttgcctccaggctctttccttcctattcctgttctatggtggggctccattgcgagacttcagattgagaaatcagatgaagtttcaagaaaaggaaactggcaggtgacagagatgggtggagggactggggaaaggctgtttactccctcctgtctagtcggcttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagagcctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcctttatccaactctcaatttttccttggtctccagtggaagggaaaagcccatgatcttcaagcagggaagccccagtgagtagctgcattcctagaaattgaagtttcagagctacacaaacactttttctgtcccaaccattccctcacagcaaagcaacaatacaggctagggatggtaatcctttaaacatacaaaaattgctcgtattataaattacccagtttagaggggaaaaaaagaaaataattattcctaaacaaatggataagtagaattaatggttgaggcaggaccctacagagtgtgggaactgctggggatctagagaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggttaaggctaaacgggggatcctcta

SEQ ID NO: 302586 - DNA, 1587 bp, Homo sapiens
gattctgtgtgtgtcctcagatgctcagccgcagacctttgggagagtaaagggggcacacccacccaccttgcctccaggctctttccttcctattcctgttctatggtggggctccattgcgagacttcagattgagaaatcagatgaagtttcaagaaaaggaaactggcaggtgacagagatgggtggagggactggggaaaggctgtttactccctcctgtctagtcggcttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagagcctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcctttatccaactctcaatttttccttggtctccagtggaagggaaaagcccatgatcttcaagcagggaagccccagtgagtagctgcattcctagaaattgaagtttcagagctacacaaacactttttctgtcccaaccattccctcacagcaaagcaacaatacaggctagggatggtaatcctttaaacatacaaaaattgctcgtattataaattacccagtttagaggggaaaaaaagaaaataattattcctaaacaaatggataagtagaattaatggttgaggcaggaccctacagagtgtgggaactgctggggatctagagaattcagtgggaccaatgaaagcatggctgagaaatagcaggtagcccttaacttcgggatcctctagatca

SEQ ID NO: 302587 - DNA, 2066 bp, Homo sapiens
aagcagtggtatcaacgcagagtgcccattacggccgggggtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagagcctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcctttatccaactctcaatttttccttggtctccagtggaagggaaaagcccatgatcttcaagcagggaagccccagtgagtagctgcattcctagaaattgaagtttcagagctacacaaacactttttctgtcccaaccattccctcacagcaaagcaacaatacaggctagggatggtaatcctttaaacatacaaaaattgctcgtattataaattacccagtttagaggggaaaaaaagaaaataattattcctaaacaaatggataagtagaattaatggttgaggcaggaccctacagagtgtgggaactgctggggatctagagaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatgata

SEQ ID NO: 302588 - DNA, 614 bp, Homo sapiens
  misc_feature (577)..(577): n is a, c, g, or t
gtggcccggaggggcctgagctaaatccgcaggacctgggtaacacgaggaagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagagcctcatctcaagccaggcctcgagctacttcattgacgctgccacagtcaacgacagtggagagtacaggtgccagacaaacctctccaccctcagtgacccggtgcagctagaagtccatatcggccatttcccgaccatgacctcatgttctctctttgtgaagtctgattacttggtgacatgattgtgagaataagctctggcgatataagaatttcctctcttgaaggccatgctcagtaaattacttggtgacatgatcgtgagaataagctctggcgantacaagaatttcctctcttgaaggccatgctcagtaa

SEQ ID NO: 302589 - DNA, 765 bp, Homo sapiens
ccccctttacctctcttttgtttttattatttttatctttcctttccttgtcttttctcatttcccactctatgaattccttagcatgccagccatagctgtgaacacttgtttactcccttgagttgcttttgaacagatgaaaagtcattcttgctgttgtagcaggttgctgtgcactgcagatttcgttttatgaaatgggaacatgccgcctacttggtagcccttaagaatcaggccagtctaactactgcctctcccgtgtgaaccacagccccactgtccatagtgtctttgtgcaaactgtaatgaatgtccctgcctccagaggagtgcagtaccacacctagccagcagagtgcaggtgggattccaaccccacttccaatccctcagccagacaccctagcatcttgcacacagctctctgtggcagtctcgtgtgggcacgcttaaatctcgcttgttacctcataacatacttacaatgactgcttcccattaactcctctatgcatctttctgtaaacttttgtcctccaaatttcatcaaataattggcagggggaggaggtggcaaaagagagaaacatgccttgctgtgaagaaacatcagagctctttgaaggccattgcagttaactagacctatgtctgagcttgaagcagatattgaccgtgaaaatggcagtgctgggaataatgaggcctggaagctacgaagatgaggttgtaggggaagatttgttgatgtggaactat

SEQ ID NO: 302590 - DNA, 4929 bp, Homo sapiens
  misc_feature (1560)..(1560): n is a, c, g, or t
  misc_feature (1562)..(1562): n is a, c, g, or t
  misc_feature (1640)..(1640): n is a, c, g, or t
ttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccgtatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaangnattccacatacatcaaagaatttgataagaatatagccttgctggatgaacagtgcaagaaaaatccaggttttgctnctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggacgtggccgctttggagagtcagcctttattaggattcactgttattcaagttaaagatgagaattccgagtctaaagtatttcagttactgcacaaaaacatgttattttatgtattcaaagcagaggatgctcattcggctcagaagtggatagaagcatttcaggaaggcacaatattgtagcagtattggtttcatctcttctgtgattccaaagaggtggaatttcatcagaatggagtaaatgcaattcaaaaattgtataaaaatgaacactgccaagataaagccaaccagacccttcatcaaagaaattgttttgttaggtataagcaatttttaaaaggtgtttgttttttcatttatgttatttattaaaattttgatgtttacttaatggtcagaattatttctgagacacactgaattctaaagtaccatttctttagagaccagaaaaactatcttaatactgtatactgtattaactattcgtgacatagttcacactgttttcttaccttacattgtaacaatcttactggtggaaagtctttgtaaggaaaaaacacatagcaaggagcaaatttccacaaagtgcttggtttaggaattgtgattattataaaactgctgatgaaaaaaatgcatgtctttgaatcaataaacttgggtgaatatttgtatcttttagtggaaaaacatggccagcttctacctcagtaactgtgaactgaaatttcagtaaattatctaaagtatttctgttgttaggtacctctttggcaggagttaatattacatcatcaaagaattatagcaaagagatagaatctgaattttttaaaactgtgagtaggaatgaagatgtttttatttgcagaataccacaaataaccaactcttccggcttttaagtccaatcttttaaaaaatctaccacttcgaaacaaacataaatgtatcattttttaaaatagcaaaatatagcaagcattatgtcacataatattccctgctattataagagttctgagcccaagtcaatgatgatatttgtatctataagtaatgttacatttccaaaaatattgtgcattacaaatggaactggaattactatatcagaaaagcataattataagccagtaataactgaaattctatagtattcattttcaaaaggtctttttctgccagtttgtgatatcctccctcctaattaaaaaaaaaaacaacaaatcctttctctataagcagctatcagcacacctccttaggaaagatttagattcataattctggtgcacttactgtttaacatatgaactaccttgcacatacaattgttgattagcagaagaaaatgaaataacactgtgataaaagccatccctgatgttcacaatacacaatttattaactaagtttaaactataaattatcttaactgccatgagcggtggctcacacctacaatctcagcattttgggaggccgaggccgttggaccacctgaggtcaggagatcgagaccagcctggccaatatggtgaaaccccatctctattaaaaatacaagaattagccggtcgtggtggtacatggctgtagtcctagctattcagcaggctgaggcaggagcatcgcttgaacccaggaggcagaggttgcagtgagccgagatggtgccactgcactccagcctgggatgacagagcgagactccatctcaaaaaaaaaaaaaaaaaaaaattgaacagcaaggttatccatataatatttctttaaagggtacaagaattttcctttctgcctctaaataaaggatttcctaattcagtgtgatccttaacagcaaccatgaggattactgagtgcctttctggggccttttgaatgctgtttggtacagcaccagagtccctactagatctagagttggctgctatagttttttgtggcgattttttgccatggagtcatttgaacctcatacacaatcctaacatgccatcccctttctgtcatagcaggtacactaaaatttctttgtagctcaattttatataatcaagatcacataaataaggcttccatgttagaatcgttgcagtttttagtgtattcctttttggaggctaaagttgtac

SEQ ID NO: 302591 - DNA, 3740 bp, Homo sapiens
  misc_feature (1560)..(1560): n is a, c, g, or t
  misc_feature (1562)..(1562): n is a, c, g, or t
  misc_feature (1640)..(1640): n is a, c, g, or t
ttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccgtatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaangnattccacatacatcaaagaatttgataagaatatagccttgctggatgaacagtgcaagaaaaatccaggttttgctnctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggtaagatctgaaatctaaagatgagtaatttggggttttgtaatgccaactgcaagtaattacaatattttaaaaatccatttattttacataagattttttgctttgcttttggatgggggaggtgttgttgctgttatttttaatgtgaacagtgttcttgctttgtacctggagagctctttctcaaatgtgttaggaattttccatattattaaaatgcaatttttgtgtgtgtcgtgtgactactaattactttactaaaggcagagctgcccccaggtgcactggctcacacctgtaatcccagcactttgggaggctgagtgggggtggatcacctgaggtcaggagttcgagactagcctggccaacatggcgaaaccccgtctctactaagaatacaaatattagtggagtgcctgtaatcccagacacttgggagggtgaagcaggagaattgcttgaacccgggaggcagaggttgcagtgagccgagatggtgccactgcactccagcctgggatgacagagcgagactccatctcaaaaaaaaaaaaaaaaaaaaattgaacagcaaggttatccatataatatttctttaaagggtacaagaattttcctttctgcctctaaataaaggatttcctaattcagtgtgatccttaacagcaaccatgaggattactgagtgcctttctggggccttttgaatgctgtttggtacagcaccagagtccctactagatctagagttggctgctatagttttttgtggcgattttttgccatggagtcatttgaacctcatacacaatcctaacatgccatcccctttctgtcatagcaggtacactaaaatttctttgtagctcaattttatataatcaagatcacataaataaggcttccatgttagaatcgttgcagtttttagtgtattcctttttggaggctaaagttgtac

SEQ ID NO: 302592 - DNA, 446 bp, Homo sapiens
tcggtaaccccggagatttcgtagatccccaaaaaaaaaaaaaaaaaattgaacagcaaggttatccatataatatttctttaaagggtacaagaattttcctttctgcctctaaataaaggatttcctaattcagtgtgatccttaacagcaaccatgaggattactgagtgcctttctggggccttttgaatgctgtttggtacagcaccagagtccctactagatctagagttggctgctatagttttttgtggcgattttttgccatggagtcatttgaacctcatacacaatcctaacatgccatcccctttctgtcatagcaggtacactaaaatttctttgtagctcaattttatataatcaagatcacataaataaggcttccatgttagaatcgttgcagtttttagtgtattcctttttggaggctaaagttgtac

SEQ ID NO: 302593 - DNA, 1470 bp, Homo sapiens
ttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccgtatgaagctccagatggccagctgcagcttggacccagacatcagcattccaggtctcgctctgtcaacccaggttggagtgcagtggcaagatcacagctcactgcagcctcaacctcccagacttagagatggggcttcaccatgttgccaaggctggtctcgaactctgggctgaagcgatcctccctcatcggcttcccaaagtgctgggattacagacgtgagccactgcacccagctagattgactcttgatagcagtgattctaagcagctttaattcttattgagccctcacagtgttaagaagcaaaaacattttttgtgtgctcttttgtactctacaaattaatgtcttctctgcctggtctttgaaatcttggccccagtaaatatctgtgctgctatgcagct

SEQ ID NO: 302594 - DNA, 3012 bp, Homo sapiens
  misc_feature (1560)..(1560): n is a, c, g, or t
  misc_feature (1562)..(1562): n is a, c, g, or t
  misc_feature (1640)..(1640): n is a, c, g, or t
ttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccgtatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaangnattccacatacatcaaagaatttgataagaatatagccttgctggatgaacagtgcaagaaaaatccaggttttgctnctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggtaagatctgaaatctaaagatgagtaatttggggttttgtaatgccaactgcaagtaattacaatattttaaaaatccatttattttacataagattttttgctttgcttttggatgggggaggtgttgttgctgttatttttaatgtgaacagtgttcttgctttgtacctggagagctctttctcaaatgtgttaggaattttccatattattaaaatgcaatttttgtgtgtgtc

SEQ ID NO: 302595 - DNA, 1236 bp, Homo sapiens
tgctgggattacaagcttaagccaccgcgcctggcctagatggatttcttgtaccagactataccctagacatgaaaacaagactgttaaacaaaatcctgtgctacctaaagtttgagccttctgtgtgtcagtttctgccataataaataactcttaactatgattattaagtatattaagaactttgagtaggggaggcacgtttaatcattcgtttttacggcatatgtactataatacctgtgtgttgcaaatcctggtatttaaaagtctttttgtgtatttgagcatgtaagtttatttggtccaaactgctggtactagtaaagacaagtccagggcataagtaggacttacagcaccaagttcgtcttttttttttgagacagagtctcagtcggtcacccaggctggagtgcattggtacagtctgggctcactgcaccctccacctcccgagttcaagcgattctcctgcctcagcctcccaagtagctgggattacaagtgtgtgccgccacgcccggttaatttttgtattttttagtagagatggagttttcactatgttgggccaggctgatcccgacctcaggtgatgtgcccaccttggtctccgaaagtgctgggattataggcgtgagccactgcgcctgacctccaagtccatctttcaaaggctctgttgataattgactcttgagagtcattacagtccatcaacagcctgtattctgaatatttgtttttaattctaagacaatgctaaatagccattccaaataaggtgagaactgagactttagggcctgtattatcagctgtacactgacaagctctgaactctattgctttttcaaatcagagaagaaaaatgagtaagaaaagaaaaatatggatcacttaggctttgatgcctcctctgagtttatagtgtttaccttctgtattacttaggtgatcctctctaatggcattttaaatctctgttgatacttgtcttacttatgtatctgtttttttttcctctatagtagatagaatttatagatatatatgtattttaaagtaagatacaatttacgtaccttacaatttacccatttaatctaattcagggttatgcaaccctatgaatttagtagtttattcatagagttatgcaaccatcactgtaatcaattttcaacaccctcaaaagaaaccccatatccattagcagtcacttcccat

SEQ ID NO: 302596 - DNA, 823 bp, Homo sapiens
gttcatattctaaagagagcaggcactgagcaaatgtttgttgaactgaaccaatctgctagttatggggacatgacctccacttcatggtgttgaactaaacaaacacatacttctccagacaaatattaaaactggtgaacttcaaaataacgtgaaaagctcctatgtttccatgcctcattatatgccacaaaaaatcaaatgataacgagaacaaattccctaggtccagcacaaatagaggagggttcactcgtaggcagcatctgagcaacaggctcaccagacttcagcctcttcactccgactcttccacgctccagctctcttcattaagatattctagaagcaactgaggagtttctacaaacattttggaaattacagcaggtcaagtggaagtttgttttcatttcagttaaggtacgagttgttctgactgctgtgcagacattcacacgcccgctgctagaaagctggagctggaaggagcatcggggcccgctgagtcctcctttctcatgtatggatgtggatgtggaggcaggccctaagtcttagtgtaggtgccgatggtgcaggttgactcacttaaagaagaatttgaatcattatctaacagaaaaagatcaataacaagcattattgctggaacattctatggatagactgctttctatacatgattggtgaatattgtatttcaattaattatatatcctgataatatatgaattaatactgtgatatcctgcatataataacaataatcaatggaaatatagtaaaacagaaatgaaaataaaactggatgcgtccg

SEQ ID NO: 302597 - DNA, 356 bp, Homo sapiens
gaagcttcagggcatcatggcaggagcttgggctgtggaggctggggtgggtctgcgtttgaacccagctcctcctgggggagtgactgcagccaagtgcctcggaattcctcttgatgtgagggttgggacctccatcccccaggagttttggggatggggaagttgggtgagatattctaagtgaacgcactctgaatgtcagctatcacttttttctcagcaggtcaagtggaagtttgttttcatttcagttaaggtacgagttgttctgactgctgtgcagacattcacacgcccgctgctagaaagctggagctggaaggagcatcggggcccgctgagtcctcctttct

SEQ ID NO: 302598 - DNA, 335 bp, Homo sapiens
aaaaaaaaaagattaggactgaaaaatggttaggcagtgtcagaactcagagactgacagcttgagaatgagaaacactgtcctgcctggtggttaagagcatgagcccccaccggggacccagctctgccaggtgtgcttgtgggagcgtgagccaccactggaatctctgaatgtctgtgtcctcatctctaatgccagagctcacaatacctcccttgcagggctattgtgagaataaaataagatgcaggtaaatcttagctcagtgcctgccatgaaggaggtgggtgttgaaatcatgaataaaagaataaagattaaggatgtgaata

SEQ ID NO: 302599 - DNA, 552 bp, Homo sapiens
aaaaaaaaaagattaggactgaaaaatggttaggcagtgtcagaactcagagactgacagcttgagaatgagaaacactgtcctgcctggtggttaagagcatgagcccccaccggggacccagctctgccaggtgtgcttgtgggagcgtgagccaccactggaatctctgaatgtctgtgtcctcatctctaatgccagagctcacaatacctcccttgcagggctattgtgagaataaaataagatgcaggtaaatcttagctcagtgcctgccatgaaggaggtgggtgttgaaatcatgaataaaagaataaagattaaggatgtgaataatataattgtctttaagtgggttctggatagttttttcccccatgggtgctgaagaagtcctgaataaaagaaagatcaaggctgggcgtggtggctcatgcctgtaatcccagcattctgggaggccgaggcgggtggattacttgaggtcaggagttcgagaccagcctggccaacatagtaaaaccctgtctctactaaaaattcaaaaattag

SEQ ID NO: 302600 - DNA, 342 bp, Homo sapiens
gggatgccccagcagcgtgctgcttacagagccccagggtccaaggctcagctctcccccttagaagggtagggcaggagcactagccccggttagatgacagctgggaccaggagctgctggtggagacacgagatggtctcctgctgtgaggggcttccccggactccaccaggcccttcctttcccagagcctccacgtgggtcagggagtcaaggacggcagccacctcctcagtgtggacacaggccccgcccccacgccctgcagccaggtgaactgacagacaccaggggtagatctggggctgctgataaaaaggaatgagcccccacggcctg

SEQ ID NO: 302601 - DNA, 1557 bp, Homo sapiens
gggaatttccccagcatcccaaagcttgagtttcctgccagtcgggagggatgaatgcagataaagggagtgcagaaggcacgaggaaaccaaagtgctctgtatcctccagtctccgcgcctccacccagctcaggaacccgcgaaccctctcttgaccactatgagcctcccgtccagccgcgcggcccgtgtcccgggtccttcgggctccttgtgcgcgctgctcgcgctgctgctcctgctgacgccgccggggcccctcgccagcgctggtcctgtctctgctgtgctgacagagctgcgttgcacttgtttacgcgttacgctgagagtaaaccccaaaacgattggtaaactgcaggtgttccccgcaggcccgcagtgctccaaggtggaagtggtagcctccctgaagaacgggaagcaagtttgtctggacccggaagccccttttctaaagaaagtcatccagaaaattttggacagtggaaacaagaaaaactgagtaacaaaaaagaccatgcatcataaaattgcccagtcttcagcggagcagttttctggagatccctggacccagtaagaataagaaggaagggttggtttttttccattttctacatggattccctactttgaagagtgtgggggaaagcctacgcttctccctgaagtttacagctcagctaatgaagtactaatatagtatttccactatttactgttattttacctgataagttattgaaccctttggcaattgaccatattgtgagcaaagaatcactggttattagtctttcaatgaatattgaattgaagataactattgtatttctatcatacattccttaaagtcttaccgaaaaggctgtggatttcgtatggaaataatgttttattagtgtgctgttgagggaggtatcctgttgttcttactcactcttctcataaaataggaaatattttagttctgtttcttggggaatatgttactctttaccctaggatgctatttaagttgtactgtattagaacactgggtgtgtcataccgttatctgtgcagaatatatttccttattcagaatttctaaaaatttaagttctgtaagggctaatatattctcttcctatggttttagatgtttgatgtcttcttagtatggcataatgtcatgatttactcattaaactttgattttgtatgctattttttcactataggatgactataattctggtcactaaatatacactttagatagatgaagaagcccaaaaacagataaattcctgattgctaatttacatagaaatgtattctcttggttttttaaataaaagcaaaattaacaatgatctgtgctctgaaagttttgaaaatatatttgaacaatttgaatataaattcatcatttagtcctcaaaatatatacagcattgctaagattttcagatatctattgtggatcttttaaaggttttgaccattttgttatgaggaattatacatgtatcacattcactatattaaaattgcacttttattttt

SEQ ID NO: 302602 - DNA, 1631 bp, Homo sapiens
gggaatttccccagcatcccaaagcttgagtttcctgccagtcgggagggatgaatgcagataaagggagtgcagaaggcacgaggaaaccaaagtgctctgtatcctccagtctccgcgcctccacccagctcaggaacccgcgaaccctctcttgaccactatgagcctcccgtccagccgcgcggcccgtgtcccgggtccttcgggctccttgtgcgcgctgctcgcgctgctgctcctgctgacgccgccggggcccctcgccagcgctggtcctgtctctgctgtgctgacagagctgcgttgcacttgtttacgcgttacgctgagagtaaaccccaaaacgattggtaaactgcaggtgttccccgcaggcccgcagtgctccaaggtggaagtggtagcctccctgaagaacgggaagcaagtttgtctggacccggaagccccttttctaaagaaagtcatccagaaaattttggacagtggaaacaagaaaaactgagtaacaaaaaagaccatgcatcataaaattgcccagtcttcagcggagcagttttctggagatccctggacccagtaagaataagaaggaagggttggtttttttccattttctacatggattccctactttgaagagtgtgggggaaagcctacgcttctccctgaagtttacagctcagctaatgaagtactaatatagtatttccactatttactgttattttacctgataagttattgaaccctttggcaattgaccatattgtgagcaaagaatcactggttattagtctttcaatgaatattgaattgaagataactattgtatttctatcatacattccttaaagtcttaccgaaaaggctgtggatttcgtatggaaataatgttttattagtgtgctgttgagggaggtatcctgttgttcttactcactcttctcataaaataggaaatattttagttctgtttcttggggaatatgttactctttaccctaggatgctatttaagttgtactgtattagaacactgggtgtgtcataccgttatctgtgcagaatatatttccttattcagaatttctaaaaatttaagttctgtaagggctaatatattctcttcctatggttttagatgtttgatgtcttcttagtatggcataatgtcatgatttactcattaaactttgattttgtatgctattttttcactataggatgactataattctggtcactaaatatacactttagatagatgaagaagcccaaaaacagataaattcctgattgctaatttacatagaaatgtattctcttggttttttaaataaaagcaaaattaacaatgatctgtgctctgaaagttttgaaaatatatttgaacaatttgaatataaattcatcatttagtcctcaaaatatatacagcattgctaagattttcagatatctattgtggatcttttaaaggttttgaccattttgttatgaggaattatacatgtatcacattcactatattaaaattgcacttttattttttcctgtgtgtcatgttggtttttggtacttgtattgtcatttggagaaacaataaaagatttctaaaccactga

SEQ ID NO: 302603 - DNA, 1926 bp, Homo sapiens
gggaatttccccagcatcccaaagcttgagtttcctgccagtcgggagggatgaatgcagataaagggagtgcagaaggcacgaggaaaccaaagtgctctgtatcctccagtctccgcgcctccacccagctcaggaacccgcgaaccctctcttgaccactatgagcctcccgtccagccgcgcggcccgtgtcccgggtccttcgggctccttgtgcgcgctgctcgcgctgctgctcctgctgacgccgccggggcccctcgccagcgctggtcctgtctctgctgtgctgacagagctgcgttgcacttgtttacgcgttacgctgagagtaaaccccaaaacgattggtaaactgcaggtgttccccgcaggcccgcagtgctccaaggtggaagtggtagcctccctgaagaacgggaagcaagtttgtctggacccggaagccccttttctaaagaaagtcatccagaaaattttggacagtggaaacaagaaaaactgagtaacaaaaaagaccatgcatcataaaattgcccagtcttcagcggagcagttttctggagatccctggacccagtaagaataagaaggaagggttggtttttttccattttctacatggattccctactttgaagagtgtgggggaaagcctacgcttctccctgaagtttacagctcagctaatgaagtactaatatagtatttccactatttactgttattttacctgataagttattgaaccctttggcaattgaccatattgtgagcaaagaatcactggttattagtctttcaatgaatattgaattgaagataactattgtatttctatcatacattccttaaagtcttaccgaaaaggctgtggatttcgtatggaaataatgttttattagtgtgctgttgagggaggtatcctgttgttcttactcactcttctcataaaataggaaatattttagttctgtttcttggggaatatgttactctttaccctaggatgctatttaagttgtactgtattagaacactgggtgtgtcataccgttatctgtgcagaatatatttccttattcagaatttctaaaaatttaagttctgtaagggctaatatattctcttcctatggttttagatgtttgatgtcttcttagtatggcataatgtcatgatttactcattaaactttgattttgtatgctattttttcactataggatgactataattctggtcactaaatatacactttagatagatgaagaagcccaaaaacagataaattcctgattgctaatttacatagaaatgtattctcttggttttttaaataaaagcaaaattaacaatgatctgtgctctgaaagttttgaaaatatatttgaacaatttgaatataaattcatcatttagtcctcaaaatatatacagcattgctaagattttcagatatctattgtggatcttttaaaggttttgaccattttgttatgaggaattatacatgtatcacattcactatattaaaattgcacttttattttttcctgtgtgtcatgttggtttttggtacttgtattgtcatttggagaaacaataaaagatttctaaaccactgaaaaaaaacaaacacccccccccaaccccacacccccaactcacacccgcacactaccccccaccccaccacagacacgcacgcacacgaaaccagccacgcacagccgcccctagccaatacccctctccagacacaccccgccccaccacacgcacacatacccgccccgaccccactagtacctcaccaccacccaccccccccacgaacacccaccacgcaacccctaccgcccccctcacgaacccgaccgcacccgacacacacccaccccacactcgccactacccccg

SEQ ID NO: 302604 - DNA, 327 bp, Homo sapiens
ctgaaggcctgaatagaacaaaaaggctcaccgtcccatgaatagagagaactcctcctgcctgactggtgtgagctgggacatccattgttttctgttttttggatttgaactgaaacatcagctcttccttgatcctgaacctgctggctttctgaccggaacttgcaccaacagctctcctagttctcaggcctttggacttggactggaattacaccatcaaatctcctgggtctccagcttgccatctgcagatcttggaacttcttaacctccacatcctgtgagccaattccttataataaatctctttataaatatata

SEQ ID NO: 302605 - DNA, 4969 bp, Homo sapiens
  misc_feature (727)..(727): n is a, c, g, or t
ggaaggtcctagtagaaggcattcccaagtgaggggagccctggacctggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgacctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcancgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcacacacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggactgcagtggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaacagatgcacgctgtacagtgcctctggaaggtgcggtgggacttgctgggtcaaagcacggcaggctctgtgctgggcaaacagggccccgcggcagcccaagggcagcctgcagacgccagtgtgcccggcttctcccatgttctgagatgggggaggggaaggtgtaaaagagagctggatgggggctgtggggactgagggtcctgggaggctggccaggggctcagcaagcgcccactttgggaggccttgccctctgggctgtggttggacagcactaggcctgcaggctgggctgccaggaggaagagcagctccggacctcaggcccccccagcaggcggcgatggagggtgatgggagaattgacgagtgctcgcggggtctcactcgggaaagggccggttaactctgagcaactgggagcctcgctcccaccccagtgcctggaaacacaaacagtattttattgagccttggctgccggggctctggtttcaggaaaagcctcagtcctgcatttgtgaatttttaaggaggcaaacaaggtgaatttgaccttcctaggagtgggagttagggaaaattcaggctgccctaccaagcccttggaaccgtgcagcaggggtcaggggagggatgggcaaaggcggtttggcccatggagcaggtctcctggtcctcccggagcacggggggcggggagctccagctcttcatcaagcgccctttggggtttccaactgttttctgttgttctctgtgtgtcttttccccttttgcctgggggcgggggctggaggggaacatacctcttatctacatcactcgggtctcatgtctgaagggcctgtctcacctgccacctacctggccttggcctcgacatctgagcgcctcatcacctcctctccacatgcccaggggtgcccctcccaaggctggctgggcaggtcccacggactaggccccaggaggagcagtgggcttcccccaggaaagagcagagccagcactgcctgcctggggagggcacccactaccaggcatggctggtggctccgtttaaagaaatctttgtccatgtgggagtgggaggtgcttccccatcctgcctggaagccacgtcctggctcttaccgtggactctgcaacagccgtggtggccacatgaagatggagaaacctggtggctcaggggcccctgatgtcaccgcctccaaggcaacgggactgggcagggcagctcctcaggaaggatgatcccacctgcacgggtcagccctgcagggggacaaggcccaccacaaccccacctcaggccaccaactggacctgtcctgccaagaaggtcccttccaatttgtccggcagctggttccctggatacagcccagacgcagcatcatcctcatgttcacctctgctgtgccctacttcccccgtaaatgacaactgtgtagtcacccacgccgggcaagagaacataggtgccacctggcgggccacacttttcaggggccgtgcctcgggcaggcccggctctctgttgtcccgcagccctcagggctggcggtggctgctcagtgcctagggagtgcccttgccacacagctgggcagcgagcatgactcagcgtttacactcaaccagccgcacaggctccagaggggaagttctctggggtccttctatgagagagcatcctgtctgcagccctgttctggctccttccacatcattcatgcattcatcccacgaggactatggtaccgtgggctcgctctagggaagcaaggcaggagcgcactggggctacttggattcccggggcagacacatatgtaccctgcacaccctcaaatgagcaaagccaccccactggcccctgggtgaggccatgtggacccccacacctttggggccggctgggcaaaccttgaacccccaatttctgcgtggcctttggctgccctccttctccaaggcgtgactcttactccagagactcaggcgagcacgtgtcccttaccttattttctctcaatcaaactgaaaccc

SEQ ID NO: 302606 - DNA, 2007 bp, Homo sapiens
ccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtcttctttgatgtgaggattggagacaaagatgttggcagaattgtgattggcctctttggaaaagttgtgcccaagacagtggaaaattttgttgctctagcaacaggagagaaaggatatggatataaaggaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgacagtggtgcactccatagagctccaagcaactgatgggcatgaccgtccactcaccagctgctcgatcattaacagtggcaagatagacgtgaaaacgccttttgtggttgagatcgctgattggtgacacaactggcacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggactgcagtggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaac

SEQ ID NO: 302607 - DNA, 739 bp, Homo sapiens
ggggttggagagagtggggggcggcggcacagtgggccggggaggagagagccgcagagggaaaccgattttaagatgaaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactggtgaggctcagggggatgggtg

SEQ ID NO: 302608 - DNA, 6525 bp, Homo sapiens
  misc_feature (4346)..(4346): n is a, c, g, or t
ggggttggagagagtggggggcggcggcacagtgggccggggaggagagagccgcagagggaaaccgattttaagatgaaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgtgcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgacctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcancgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcacacacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggactgcagtggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaac

SEQ ID NO: 302609 - DNA, 6544 bp, Homo sapiens
  misc_feature (4365)..(4365): n is a, c, g, or t
ggggttggagagagtggggggcggcggcacagtgggccggggaggagagagccgcagagggaaaccgattttaagatgaagttttcctcccgtccagcaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgtgcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgacctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcancgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcacacacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggactgcagtggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaac

SEQ ID NO: 302610 - DNA, 6496 bp, Homo sapiens
  misc_feature (4317)..(4317): n is a, c, g, or t
tgacgtgttccagcagtggaaatactgcaccgagatgcagctcaaagaccaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgtgcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgacctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcancgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcacacacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggactgcagtggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaac

SEQ ID NO: 302611 - DNA, 6454 bp, Homo sapiens
  misc_feature (4275)..(4275): n is a, c, g, or t
tgacgtgttccagcagtggaaatactgcaccgagatgcagctcaaagaccaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgtgcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgacctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcancgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcacacacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggactgcagtggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaac

SEQ ID NO: 302612 - DNA, 9879 bp, Homo sapiens
  misc_feature (4346)..(4346): n is a, c, g, or t
ggggttggagagagtggggggcggcggcacagtgggccggggaggagagagccgcagagggaaaccgattttaagatgaaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgtgcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgacctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcancgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcacacacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggactgcagtggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaacagatgcacgctgtacagtgcctctggaaggtgcggtgggacttgctgggtcaaagcacggcaggctctgtgctgggcaaacagggccccgcggcagcccaagggcagcctgcagacgccagtgtgcccggcttctcccatgttctgagatgggggaggggaaggtgtaaaagagagctggatgggggctgtggggactgagggtcctgggaggctggccaggggctcagcaagcgcccactttgggaggccttgccctctgggctgtggttggacagcactaggcctgcaggctgggctgccaggaggaagagcagctccggacctcaggcccccccagcaggcggcgatggagggtgatgggagaattgacgagtgctcgcggggtctcactcgggaaagggccggttaactctgagcaactgggagcctcgctcccaccccagtgcctggaaacacaaacagtattttattgagccttggctgccggggctctggtttcaggaaaagcctcagtcctgcatttgtgaatttttaaggaggcaaacaaggtgaatttgaccttcctaggagtgggagttagggaaaattcaggctgccctaccaagcccttggaaccgtgcagcaggggtcaggggagggatgggcaaaggcggtttggcccatggagcaggtctcctggtcctcccggagcacggggggcggggagctccagctcttcatcaagcgccctttggggtttccaactgttttctgttgttctctgtgtgtcttttccccttttgcctgggggcgggggctggaggggaacatacctcttatctacatcactcgggtctcatgtctgaagggcctgtctcacctgccacctacctggccttggcctcgacatctgagcgcctcatcacctcctctccacatgcccaggggtgcccctcccaaggctggctgggcaggtcccacggactaggccccaggaggagcagtgggcttcccccaggaaagagcagagccagcactgcctgcctggggagggcacccactaccaggcatggctggtggctccgtttaaagaaatctttgtccatgtgggagtgggaggtgcttccccatcctgcctggaagccacgtcctggctcttaccgtggactctgcaacagccgtggtggccacatgaagatggagaaacctggtggctcaggggcccctgatgtcaccgcctccaaggcaacgggactgggcagggcagctcctcaggaaggatgatcccacctgcacgggtcagccctgcagggggacaaggcccaccacaaccccacctcaggccaccaactggacctgtcctgccaagaaggtcccttccaatttgtccggcagctggttccctggatacagcccagacgcagcatcatcctcatgttcacctctgctgtgccctacttcccccgtaaatgacaactgtgtagtcacccacgccgggcaagagaacataggtgccacctggcgggccacacttttcaggggccgtgcctcgggcaggcccggctctctgttgtcccgcagccctcagggctggcggtggctgctcagtgcctagggagtgcccttgccacacagctgggcagcgagcatgactcagcgtttacactcaaccagccgcacaggctccagaggggaagttctctggggtccttctatgagagagcatcctgtctgcagccctgttctggctccttccacatcattcatgcattcatcccacgaggactatggtaccgtgggctcgctctagggaagcaaggcaggagcgcactggggctacttggattcccggggcagacacatatgtaccctgcacaccctcaaatgagcaaagccaccccactggcccctgggtgaggccatgtggacccccacacctttggggccggctgggcaaaccttgaacccccaatttctgcgtggcctttggctgccctccttctccaaggcgtgactcttactccagagactcaggcgagcacgtgtcccttaccttattttctctcaatcaaactgaaacccattgtgatcccccatagtccagtgcggtctctgttattattacgggtgtctcccttcctccccgtgcccaggacaggccatgagccagagatacaaggggccccaggcaagatgcagggctctctgctcctggctctttatcgtcgtcgggacaccctttgtccaaactcaaggaatcccgggaggtctggctttgccgctttggctgggactcaggtacctgggcatacctgcatctgtgccccctcttcgtcccagtgagacggaccctcagtatcccccccaacatagaacaggaaggtctcaagccagccccctcctccagttcaatcaccctccctcacatccacccagagaagtccagacctgtggccacttccatgccctctccagaccaggagacacctgctgctgacctcgtggaaaacttagattttgacattctgatgcttcggaagtggtggctcctcctccttcacccctccgccacctgtgggcctcctctctgcatctcaagagaacaaccagatctttgggctcctggggtgtgtgccatgcaatttagacgaagtgctttgaaaatatgccattcagtctctgactaggaaaataagtctgacctgataggtccgatgtcatcagctcttcaacatgagacaaaagaggggattttatgttttgagtcattagaatgatataataattttctgaattgacatctggatgttgaaattaggatggtgcaaaaggggtccagggcctcaggctgggcgcagcagccagctcccaatgacgcagaagctgcttcaaaaccccctcaacaaagaggggcacatgcaagtcaccaaagtgggaagccttcaccaaggccacacccaaagtctactgattgtctgtccaaagttcgttgattcctggccatgaacaagcacaatagaaaaagacacagggtcctagtggctacaagtcaatgtgaattggcacatggtctagcagttttaaaatctgacagtagagtatggcaatgggcaagggccaagaagtcctgagatgggaggtcagcgctctaactgggctcagtggaggtctgtgaccagtgtctggacactagctacaggggaccgggcagaggattctgggcagaaggaaaatgtctaaaagtactttgggagggtaaaggacaggggccttatttaaaataaagactgaaggataataagtgtcacccaggtttgtggattattggagggggcaccatctagccattctccacttttccagtgtggagaac

SEQ ID NO: 302613 - DNA, 9726 bp, Homo sapiens
  misc_feature (4346)..(4346): n is a, c, g, or t
ggggttggagagagtggggggcggcggcacagtgggccggggaggagagagccgcagagggaaaccgattttaagatgaaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgtgcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgacctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcancgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcacacacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggactgcagtggggactctaagtgtaaaactgtcatgaggatggtttatgaagtcccagggaccacacctcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaacagatgcacgctgtacagtgcctctggaaggtgcggtgggacttgctgggtcaaagcacggcaggctctgtgctgggcaaacagggccccgcggcagcccaagggcagcctgcagacgccagtgtgcccggcttctcccatgttctgagatgggggaggggaaggtgtaaaagagagctggatgggggctgtggggactgagggtcctgggaggctggccaggggctcagcaagcgcccactttgggaggccttgccctctgggctgtggttggacagcactaggcctgcaggctgggctgccaggaggaagagcagctccggacctcaggcccccccagcaggcggcgatggagggtgatgggagaattgacgagtgctcgcggggtctcactcgggaaagggccggttaactctgagcaactgggagcctcgctcccaccccagtgcctggaaacacaaacagtattttattgagccttggctgccggggctctggtttcaggaaaagcctcagtcctgcatttgtgaatttttaaggaggcaaacaaggtgaatttgaccttcctaggagtgggagttagggaaaattcaggctgccctaccaagcccttggaaccgtgcagcaggggtcaggggagggatgggcaaaggcggtttggcccatggagcaggtctcctggtcctcccggagcacggggggcggggagctccagctcttcatcaagcgccctttggggtttccaactgttttctgttgttctctgtgtgtcttttccccttttgcctgggggcgggggctggaggggaacatacctcttatctacatcactcgggtctcatgtctgaagggcctgtctcacctgccacctacctggccttggcctcgacatctgagcgcctcatcacctcctctccacatgcccaggggtgcccctcccaaggctggctgggcaggtcccacggactaggccccaggaggagcagtgggcttcccccaggaaagagcagagccagcactgcctgcctggggagggcacccactaccaggcatggctggtggctccgtttaaagaaatctttgtccatgtgggagtgggaggtgcttccccatcctgcctggaagccacgtcctggctcttaccgtggactctgcaacagccgtggtggccacatgaagatggagaaacctggtggctcaggggcccctgatgtcaccgcctccaaggcaacgggactgggcagggcagctcctcaggaaggatgatcccacctgcacgggtcagccctgcagggggacaaggcccaccacaaccccacctcaggccaccaactggacctgtcctgccaagaaggtcccttccaatttgtccggcagctggttccctggatacagcccagacgcagcatcatcctcatgttcacctctgctgtgccctacttcccccgtaaatgacaactgtgtagtcacccacgccgggcaagagaacataggtgccacctggcgggccacacttttcaggggccgtgcctcgggcaggcccggctctctgttgtcccgcagccctcagggctggcggtggctgctcagtgcctagggagtgcccttgccacacagctgggcagcgagcatgactcagcgtttacactcaaccagccgcacaggctccagaggggaagttctctggggtccttctatgagagagcatcctgtctgcagccctgttctggctccttccacatcattcatgcattcatcccacgaggactatggtaccgtgggctcgctctagggaagcaaggcaggagcgcactggggctacttggattcccggggcagacacatatgtaccctgcacaccctcaaatgagcaaagccaccccactggcccctgggtgaggccatgtggacccccacacctttggggccggctgggcaaaccttgaacccccaatttctgcgtggcctttggctgccctccttctccaaggcgtgactcttactccagagactcaggcgagcacgtgtcccttaccttattttctctcaatcaaactgaaacccattgtgatcccccatagtccagtgcggtctctgttattattacgggtgtctcccttcctccccgtgcccaggacaggccatgagccagagatacaaggggccccaggcaagatgcagggctctctgctcctggctctttatcgtcgtcgggacaccctttgtccaaactcaaggaatcccgggaggtctggctttgccgctttggctgggactcaggtacctgggcatacctgcatctgtgccccctcttcgtcccagtgagacggaccctcagtatcccccccaacatagaacaggaaggtctcaagccagccccctcctccagttcaatcaccctccctcacatccacccagagaagtccagacctgtggccacttccatgccctctccagaccaggagacacctgctgctgacctcgtggaaaacttagattttgacattctgatgcttcggaagtggtggctcctcctccttcacccctccgccacctgtgggcctcctctctgcatctcaagagaacaaccagatctttgggctcctggggtgtgtgccatgcaatttagacgaagtgctttgaaaatatgccattcagtctctgactaggaaaataagtctgacctgataggtccgatgtcatcagctcttcaacatgagacaaaagaggggattttatgttttgagtcattagaatgatataataattttctgaattgacatctggatgttgaaattaggatggtgcaaaaggggtccagggcctcaggctgggcgcagcagccagctcccaatgacgcagaagctgcttcaaaaccccctcaacaaagaggggcacatgcaagtcaccaaagtgggaagccttcaccaaggccacacccaaagtctactgattgtctgtccaaagttcgttgattcctggccatgaacaagcacaatagaaaaagacacagggtcctagtggctacaagtcaatgtgaattggcacatggtctagcagttttaaaatctgacagtagagtatggcaatgggcaagggccaagaagtcctgagatgggaggtcagcgctctaactgggctcagtggaggtctgtgaccagtgtctggacactagctacaggggaccgggcagaggattctgggcagaaggaaaatgtctaaaagtactttgggagggtaaaggacaggggccttatttaaaataaagactgaaggataataagtgtcacccaggtttgtggattattggagggggcaccatctagccattctccacttttccagtgtggagaac

SEQ ID NO: 302614 - DNA, 9879 bp, Homo sapiens
  misc_feature (4346)..(4346): n is a, c, g, or t
  misc_feature (9360)..(9360): n is a, c, g, or t
  misc_feature (9362)..(9362): n is a, c, g, or t
  misc_feature (9365)..(9365): n is a, c, g, or t
  misc_feature (9368)..(9369): n is a, c, g, or t
  misc_feature (9372)..(9372): n is a, c, g, or t
  misc_feature (9375)..(9376): n is a, c, g, or t
  misc_feature (9382)..(9382): n is a, c, g, or t
  misc_feature (9384)..(9384): n is a, c, g, or t
  misc_feature (9390)..(9390): n is a, c, g, or t
  misc_feature (9393)..(9393): n is a, c, g, or t
  misc_feature (9401)..(9401): n is a, c, g, or t
  misc_feature (9403)..(9403): n is a, c, g, or t
  misc_feature (9420)..(9421): n is a, c, g, or t
  misc_feature (9427)..(9427): n is a, c, g, or t
  misc_feature (9431)..(9432): n is a, c, g, or t
  misc_feature (9434)..(9435): n is a, c, g, or t
  misc_feature (9441)..(9441): n is a, c, g, or t
  misc_feature (9446)..(9447): n is a, c, g, or t
  misc_feature (9450)..(9450): n is a, c, g, or t
  misc_feature (9452)..(9452): n is a, c, g, or t
  misc_feature (9458)..(9458): n is a, c, g, or t
  misc_feature (9461)..(9461): n is a, c, g, or t
  misc_feature (9463)..(9464): n is a, c, g, or t
  misc_feature (9486)..(9487): n is a, c, g, or t
ggggttggagagagtggggggcggcggcacagtgggccggggaggagagagccgcagagggaaaccgattttaagatgaaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgtgcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgacctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcancgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcacacacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggactgcagtggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaacagatgcacgctgtacagtgcctctggaaggtgcggtgggacttgctgggtcaaagcacggcaggctctgtgctgggcaaacagggccccgcggcagcccaagggcagcctgcagacgccagtgtgcccggcttctcccatgttctgagatgggggaggggaaggtgtaaaagagagctggatgggggctgtggggactgagggtcctgggaggctggccaggggctcagcaagcgcccactttgggaggccttgccctctgggctgtggttggacagcactaggcctgcaggctgggctgccaggaggaagagcagctccggacctcaggcccccccagcaggcggcgatggagggtgatgggagaattgacgagtgctcgcggggtctcactcgggaaagggccggttaactctgagcaactgggagcctcgctcccaccccagtgcctggaaacacaaacagtattttattgagccttggctgccggggctctggtttcaggaaaagcctcagtcctgcatttgtgaatttttaaggaggcaaacaaggtgaatttgaccttcctaggagtgggagttagggaaaattcaggctgccctaccaagcccttggaaccgtgcagcaggggtcaggggagggatgggcaaaggcggtttggcccatggagcaggtctcctggtcctcccggagcacggggggcggggagctccagctcttcatcaagcgccctttggggtttccaactgttttctgttgttctctgtgtgtcttttccccttttgcctgggggcgggggctggaggggaacatacctcttatctacatcactcgggtctcatgtctgaagggcctgtctcacctgccacctacctggccttggcctcgacatctgagcgcctcatcacctcctctccacatgcccaggggtgcccctcccaaggctggctgggcaggtcccacggactaggccccaggaggagcagtgggcttcccccaggaaagagcagagccagcactgcctgcctggggagggcacccactaccaggcatggctggtggctccgtttaaagaaatctttgtccatgtgggagtgggaggtgcttccccatcctgcctggaagccacgtcctggctcttaccgtggactctgcaacagccgtggtggccacatgaagatggagaaacctggtggctcaggggcccctgatgtcaccgcctccaaggcaacgggactgggcagggcagctcctcaggaaggatgatcccacctgcacgggtcagccctgcagggggacaaggcccaccacaaccccacctcaggccaccaactggacctgtcctgccaagaaggtcccttccaatttgtccggcagctggttccctggatacagcccagacgcagcatcatcctcatgttcacctctgctgtgccctacttcccccgtaaatgacaactgtgtagtcacccacgccgggcaagagaacataggtgccacctggcgggccacacttttcaggggccgtgcctcgggcaggcccggctctctgttgtcccgcagccctcagggctggcggtggctgctcagtgcctagggagtgcccttgccacacagctgggcagcgagcatgactcagcgtttacactcaaccagccgcacaggctccagaggggaagttctctggggtccttctatgagagagcatcctgtctgcagccctgttctggctccttccacatcattcatgcattcatcccacgaggactatggtaccgtgggctcgctctagggaagcaaggcaggagcgcactggggctacttggattcccggggcagacacatatgtaccctgcacaccctcaaatgagcaaagccaccccactggcccctgggtgaggccatgtggacccccacacctttggggccggctgggcaaaccttgaacccccaatttctgcgtggcctttggctgccctccttctccaaggcgtgactcttactccagagactcaggcgagcacgtgtcccttaccttattttctctcaatcaaactgaaacccattgtgatcccccatagtccagtgcggtctctgttattattacgggtgtctcccttcctccccgtgcccaggacaggccatgagccagagatacaaggggccccaggcaagatgcagggctctctgctcctggctctttatcgtcgtcgggacaccctttgtccaaactcaaggaatcccgggaggtctggctttgccgctttggctgggactcaggtacctgggcatacctgcatctgtgccccctcttcgtcccagtgagacggaccctcagtatcccccccaacatagaacaggaaggtctcaagccagccccctcctccagttcaatcaccctccctcacatccacccagagaagtccagacctgtggccacttccatgccctctccagaccaggagacacctgctgctgacctcgtggaaaacttagattttgacattctgatgcttcggaagtggtggctcctcctccttcacccctccgccacctgtgggcctcctctctgcatctcaagagaacaaccagatctttgggctcctggggtgtgtgccatgcaatttagacgaagtgctttgaaaatatgccattcagtctctgactaggaaaataagtctgacctgataggtccgatgtcatcagctcttcaacatgagacaaaagaggggattttatgttttgagtcattagaatgatataataattttctgaattgacatctggatgttgaaattaggatggtgcaaaaggggtccagggcctcaggctgggntntgnttnnttnttnntatttntntgatgnttntttttttncncctccaccaagaggggnncattcnattnncnnaatttngtttnnttntntttttnttntnnttttttcttctttttttttttnntaagttcgttgattcctggccatgaacaagcacaatagaaaaagacacagggtcctagtggctacaagtcaatgtgaattggcacatggtctagcagttttaaaatctgacagtagagtatggcaatgggcaagggccaagaagtcctgagatgggaggtcagcgctctaactgggctcagtggaggtctgtgaccagtgtctggacactagctacaggggaccgggcagaggattctgggcagaaggaaaatgtctaaaagtactttgggagggtaaaggacaggggccttatttaaaataaagactgaaggataataagtgtcacccaggtttgtggattattggagggggcaccatctagccattctccacttttccagtgtggagaac

SEQ ID NO: 302615 - DNA, 866 bp, Homo sapiens
ggtctcccaggaacgtgagtgatagggtgggataagtgcagtcattaaaccaagcactcgggcctcggagctgcggggctcgttagctcacatgtcaaggttttagaattctcgttcaacagacttaactaggcgctgacgtcccacagctgaaggctggggctgggagcagggcctggaggggtgaaggcatccggagactgtgtcccacttgggatctgctaacccgggactgggctcagctctctctccaggaggctgggactgggtgaagcccctgggctgtgctcagctcccctccagaacgctgggccagggccaaggcctcattacccactgggctgcaacttgctctccttcctgggacgctggagcctgtgaggctgagttaatatcaaggagagccttggatacacgccacccatccgccgcatccggggagggtctgcagccggcagcagccgcccagctcccgtccagggaacgggggttgggaggaagggtggcttcctgcagtgtgtgcgccacacgatgcctctgggtgccacccgctgaccccggctgggtgctcggctccacacaggctctccatgactcccgaggagcacagagcgttctggcgtaatgtgcagttcactgtggacaaagacgtggtccggacagatcggaacaaccagttcttccggggggaagacaatcccaatgtggagagcatgaggtactccctccccagccagctcctttcccatctgcaagtctgcaagcctcacctgaccgctctgggaagtggatgagcccccagcgagtttctgcaggggctctcttccaggttcatacatcaaagccccagaagtgaaggatacgct

SEQ ID NO: 302616 - DNA, 1155 bp, Homo sapiens
ggggttggagagagtggggggcggcggcacagtgggccggggaggagagagccgcagagggaaaccgattttaagatgaaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagggggctgatgtctgatgaaagcgagtctgaagccaccgagtgccggtaccacacgccgcctttgcatgcggtcatcggctcgcccctggcccgggtctaggtttccctcctggctcagcctgctggacgtggacgtgcagggtggacgatctgcattaacgaagggaagcacggcatggacggtctgagaggcttcattcccaccactcccgaattaaaaaaaatcgtgcctcattgcacgttttcccagtggcagat

SEQ ID NO: 302617 - DNA, 416 bp, Homo sapiens
tcgacgcatccaggagggctggacccttttgcaggagctggctctatccaccacggcagctccagcagcctccgtcagagaaccctgaagatggaggcaaacacccatctgctggaagacatttgcgtcagcgtctcctgtcctcactcacaccgcagggggctgatgtctgatgaaagcgagtctgaagccaccgagtgccggtaccacacgccgcctttgcatgcggtcatcggctcgcccctggcccgggtctaggtttccctcctggctcagcctgctggacgtggacgtgcagggtggacgatctgcattaacgaagggaagcacggcatggacggtctgagaggcttcattcccaccactcccgaattaaaaaaaatcgtgcctcattgcacgttttcccagtggcagat

SEQ ID NO: 302618 - DNA, 6466 bp, Homo sapiens
  misc_feature (4287)..(4287): n is a, c, g, or t
ggggttggagagagtggggggcggcggcacagtgggccggggaggagagagccgcagagggaaaccgattttaagatgaaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgtgcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaatcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgacctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcancgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcacacacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggactgcagtggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaac

SEQ ID NO: 302619 - DNA, 6502 bp, Homo sapiens
  misc_feature (4323)..(4323): n is a, c, g, or t
ggggttggagagagtggggggcggcggcacagtgggccggggaggagagagccgcagagggaaaccgattttaagatgaagttttcctcccgtccagcaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgtgcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgacctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcancgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcacacacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggactgcagtggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaac

SEQ ID NO: 302620 - DNA, 1172 bp, Homo sapiens
gccttggtgtgtgcataaggccacatgacctcaggtcaggaataaaagcttagggctgagcagctcactctttggttgagaatccagttggctcccctggagtgaagttctacacagaccctggaggaaccaccccatctgtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgac

SEQ ID NO: 302621 - DNA, 1310 bp, Homo sapiens
cttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgac

SEQ ID NO: 302622 - DNA, 998 bp, Homo sapiens
  misc_feature (830)..(830): n is a, c, g, or t
acatctctgccttctcattttctcttaatttttttctttttttggcttcttggtattctttgctttcttggagctcgtcacacatttaggaggatttttgtcttttctggaatttttagttgttttttggtgggagggtctgtcagtgcatctagtcctccacactatggaagcagaagttggtttaaattcactttaaaaattgccttctgttttatcaattctgcctaaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaccngcttgcttgttttatggcctccgaagttatggttccttgtttggtgtttgcctggctccttgtctaataggcttaatcctggggccacggttccgggtggtttcccgtgtgtgtggcctttttggggctccgggcgcgttctttcttatcttcacgttcttgtccgcc

SEQ ID NO: 302623 - DNA, 1271 bp, Homo sapiens
cttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgac

SEQ ID NO: 302624 - DNA, 1184 bp, Homo sapiens
gcggcttgtggctcccaagttagggagtgagaggatcgcccgccgagggggtggctccgcagcccggctgcgcgagacgcttcccgctcggggacccgccttccgaggccaggtgaacgttaccggccccctgacctccagcagatccacacgtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgac

SEQ ID NO: 302625 - DNA, 980 bp, Homo sapiens
ttctgtaagtatccttttttgctggtctgacattttcccccaccatttcccctccgccttgtagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgac

SEQ ID NO: 302626 - DNA, 1393 bp, Homo sapiens
cttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaaggtacagatgaagtgaattctgtacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgac

SEQ ID NO: 302627 - DNA, 1278 bp, Homo sapiens
attaggaagcccaactcagcgattcaaatgaaattctatgcaaagaacgattataatttgggggacaaagtgacaaatacttggatgaaaaacaattatgtagagaagggtccaggagaattttatcattcacatctttgcttaaggaggtccttacctaagatattgcagtaggcagtcattaaacctacgtggttaggaatatctttgattccataccttctttgccaaattgatttcttacaaagccattccttctttattttactactctgtttagaggaaatcaagaaacaggagagaataatgaaacaaagcacagaagaaaacgtcagtgatttgtattcactgaattcaatattgtgtgttacttctattgcaaaagagaatgtgaatggaagaaaaaagaggagagagggaactattaatagagtagattacattgaattaatcttatttgtttctctcagggaagaaataagcatagtgaaaaatcacacaatggaaaccatcccttcccctgacctgttcccagtgttaagataacagagggaaggaagatcaatgctctgccagaggtccacaaactaagctgaccactttcttttgaatgacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgac

SEQ ID NO: 302628 - DNA, 1125 bp, Homo sapiens
cttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattacgccccttgcttacagttttaccgatttcccatttattcctcgttcttgtctatggacccactctccacatcccaatgacccctacccctagaaagaaccgctccactttaaaaaactaccccacattgagacgagtatcttgaaatgagtccaaatttatagtttagaacagtaacaatacacaaatagaaagaaaccataattagtgccaattttatcttgctctgagtacacttacttttctattggtatattgtagtgatagg

SEQ ID NO: 302629 - DNA, 614 bp, Homo sapiens
atgaaattctatgcaaagaacgattataatttgggggacaaagtgacaaatacttggatgaaaaacaattatgtagagaagggtccaggagaattttatcattcacatctttgcttaaggaggtccttacctaagatattgcagtaggcagtcattaaacctacgtggttaggaatatctttgattccataccttctttgccaaattgatttcttacaaagccattccttctttattttactactctgtttagaggaaatcaagaaacaggagagaataatgaaacaaagcacagaagaaaacgtcagtgatttgtattcactgaattcaatattgtgtgttacttctattgcaaaagagaatgtgaatggaagaaaaaagaggagagagggaactattaatagagtagattacattgaattaatcttatttgtttctctcagggaagaaataagcatagtgaaaaatcacacaatggaaaccatcccttcccctgacctgttcccagtgttaagataacagagggaaggaagatcaatgctctgccagaggtccacaaactaagctgaccactttcttttgaatggtacataagctgagaatggctttacatt

SEQ ID NO: 302630 - DNA, 573 bp, Homo sapiens
ggcaaaactcaaacatgacattcatcatatggattttccattgcttactaaaaaacctgagtcaggaagaggagtgttgtgatagaaacaataaatgctaaatgaaaacttaagctacccattgctccactggctcattggaaatgatttacagtgtaccatggaattattacagttgtgtcattgccaaataccatattatttactgtattgtgtactgatcattttacctagaaaaattccatgtcaggttatggtttctgaacctaacctaacagaagtgacatacattttaaaacgtggttggtgcaggtggcaagctgacaggtagctctgtggcagaggccgtgtttacagatatgagcagaaaaccaaacagcatggttgctaagacagctaggcctttggagctgacctctctctttttgttattttaggaattctcctactttcaaatcatttgaggagagggttgagacaactgtcacaagcctcaaggtacagatgaagtgaattctgtgtgagtgggtccattgactcaggacagcttagccattgctgcggttagtttaa

SEQ ID NO: 302631 - DNA, 1371 bp, Homo sapiens
cttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgac

SEQ ID NO: 302632 - DNA, 911 bp, Homo sapiens
cttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttatttaatggcctcagaaggtatgttcccttgtttgttgttaggcccctgacctcata

SEQ ID NO: 302633 - DNA, 947 bp, Homo sapiens
  misc_feature (32)..(32): n is a, c, g, or t
attctatagctatttctagcgtaacggaaaanggtcgttcgtagacgcagaaatacgctactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactagacgccctaagcatcccagcgacgtttttttttcaagaagcacgaacacacgacttactccattcccctttccataagtatgcccgatatgaggaatcctcttacccgcaacacactggacgacagggctgacccactcgtctcgaacctaagaaagaatagtacgagccacaaaccgataaagaatggcatggctagaagacgcactcagcttaccctgcccaagcaaaacactcaaacactaggacaccacgctaaaccacaaaccccataccggaaaggctgactcaacataaccctactgacacagcccacagaagcaatagagcatccgacaactaacattcccattctatgacacgggtccatcgaaacttcaatactcaatccgacctacgcagcgttcaaaattgtcattgcgtagcaccgcccacatcacgtactataaccatcaacatgttcccgaacccgaccacgagaccgtacacgacaaatccatcaaacaagcctctatgaagtccctcccgacaatccagcgcaccgcacgctacgcatacattaactgccaacagcatgcatggtacaaacaaaagtatcctactcgaacgtccacaagagatgtcgggcgactgctggcggcggcagatctgaataaaagaaagaaacaatcacagaacacgctcgtttccctctaccctggcaccataca

SEQ ID NO: 302634 - DNA, 1265 bp, Homo sapiens
acatctctgccttctcattttctcttaatttttttctttttttggcttcttggtattctttgctttcttggagctcgtcacacatttaggaggatttttgtcttttctggaatttttagttgttttttggtgggagggtctgtcagtgcatctagtcctccacactatggaagcagaagttggtttaaattcactttaaaaattgccttctgttttatcaattctgcctaaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgac

SEQ ID NO: 302635 - DNA, 2178 bp, Homo sapiens
cttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgactttgaattcttaatttctttgtcttaaaagttgctagttatgattttacagatgcaattttaaatcaacttttagccaggtgcggcggctcacacctgtaatcccaactattttggatgccaaggtgagaggattgcttgaggccaggagttaaagatcagcctgggcaacacagaccctgtctctacaaaaaaagaaaaaaattagccagacatagtgttgcttgcctgtagtcccagctactctagaggctgaggcaggaggattgcatgagcctaggagttcgaaactgcagtgagctatgattgcaccactgcactactccagcctgggtgacagagtgagacactgtctccaaaaatagtaataataagtagtcaacttttactgctaatttggtgaacatgagagaggatatgaaaataaatattacctcagctatcctaggatgttaaaataatctccaattttaaaattctctccaatctacatacagtagtagttagtcagataaaggatatccaaaaaagagatagctagaaaatgggagaagcagagttctgcaacccctttcagtttgtaaattgttcacatgtatgaaaataactggtatttatcaatccactcagatttctgcactaacttttatcttatatatcatatgtatctcttttctttttctaaatgggaacatatatttgttattaggtggcagagatatagccttaagatatatttgtaaaatgcacactgaatagacatccaacctaaaaaaaatcactatttaaaaagcccatataatatatacatatttgttagcatgctaattgttcatgttttgtgtttattaaatagaagtgatatatatgacattttgaagtaaagcacatctgaaaaattctactca

SEQ ID NO: 302636 - DNA, 648 bp, Homo sapiens
cttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaagcgggatcttaagcggatcagcgggaactcta

SEQ ID NO: 302637 - DNA, 421 bp, Homo sapiens
  misc_feature (78)..(78): n is a, c, g, or t
  misc_feature (140)..(140): n is a, c, g, or t
ggcacgagggcagttggtgttgctataggaggggggggggggtttttttttttaacccccaaaaagggggcccccccncccttttttttttaaaatttccccccccaaaaggggggccccaaaacccaaaaggggccccnccctttttaccaaaccgggtttttgtgttggggccccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacaca

SEQ ID NO: 302638 - DNA, 1070 bp, Homo sapiens
ctcctcgtctgtccatctctcccccacacttatgctaggtcgaggctgggtgttaatcggccgactcggccatgctacgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgccagaccgtgcgcgccctcaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggatagcgaggctgcggcaggaggagcgggagcaggagcagcggcaggcgttggagcaggcccgcaaggccgaagaggtgcaggcctgggcgcagcgcaaggagcgggaagtgctgcagctgcaggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacaca

SEQ ID NO: 302639 - DNA, 1357 bp, Homo sapiens
agaggccacacggccgggcggggcgtgagggacagcccgaggactacaggtcccaaggttccccgcgccgcttccggggcacggtggcgtcccggcaccgcggccgcagtgaggagactcggccatgctacgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgccagaccgtgcgcgccctcaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggatagcgaggctgcggcaggaggagcgggagcaggagcagcggcaggcgttggagcaggcccgcaaggccgaagaggtgcaggcctgggcgcagcgcaaggagcgggaagtgctgcagctgcaggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcgcccctgagtttctccgtccgggtctcctcatccgtcagggtgcacggtgggtaggagtagttgttggtcatcaccatctccatgagcatcttcagggtcgggtaatcctcccacgcagccaggccgatgttctctgggttgaatgcggcgacgaccagcaggaggggccaggccttccagtagagggtagagatggcgaggttcggaggctggtaccccggtgggagctggatgttttcagggtgatggtaggtgcacagattcagaacggcgtcgatcagctgggtcctccccaccttcagcacctctacatcatcggcctgcacgacagctctgctctaat

SEQ ID NO: 302640 - DNA, 1022 bp, Homo sapiens
ctcctcgtctgtccatctctcccccacacttatgctaggtcgaggctgggtgttaatcggccgactcggccatgctacgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgccagaccgtgcgcgccctcaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggtgcgtggggcgggaggcggccgaagaggtgcaggcctgggcgcagcgcaaggagcgggaagtgctgcagctgcaggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacaca

SEQ ID NO: 302641 - DNA, 736 bp, Homo sapiens
tatggctgaagtgtctgagaaaagaggaacgtggaaaagcaacctgatatcactccactgggaggccagaggggctctcaaataggacctgggttccaggcatgcttccccagggagagcaggagctgctttctcagtggggtgagaggccagcaggctgggtgggctggctggcatgtgcccaaggctcctgttcagctgggcttttctctcccgataggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacaca

SEQ ID NO: 302642 - DNA, 1096 bp, Homo sapiens
ctcctcgtctgtccatctctcccccacacttatgctaggtcgaggctgggtgttaatcggccgactcggccatgctacgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgccagaccgtgcgcgccctcaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggatagcgaggctgcggcaggaggagcgggagcaggagcagcggcaggcgttggagcaggcccgcaaggccgaagaggtgcaggcctgggcgcagcgcaaggagcgggaagtgctgcagctgcaggtgggcaacgtctccggagggtgggactccagccggggacgcggcttgcggggcactggggaattctgggcaccgcgacgcgggcgctggctatgtgcagagacttacagttggcaggtccggatttggagaggagagtgccagtcaggcgcaaagacccggaggtgagcggagtaattggacagtgttcaggtacctagcaggtctgtgggagggaccctgcgttccacaaagaggttgtattttgcataacaggtgatgaagccatgaagggttaagtatttcaggctaggattagcaggtgtgcgacttaaaagcagggagaccacttaggagtaatgcagtgagaatggatgaggcttgatttaaagtatagaagggtggctgggagcggtggttcacgcctgtaatcccagtactatgggaggccgaagcgggcgtatcacttgaggtcgggagttcgagtccagcctggccaagccccgtctctcctaaaaatacaaaaattagccgggcgtggtgtgcgccagtaatcgcagcta

SEQ ID NO: 302643 - DNA, 277 bp, Homo sapiens
ctcctcgtctgtccatctctcccccacacttatgctaggtcgaggctgggtgttaatcggccgactcggccatgctacgcgcgctgagccgcctgggcgcggggaccccgtgcaggccccgggcccctctggtgctgccagcgcgcggccgcaaatctttttttttttttttttttttttttttttttttttttttttttttttttgggggttcaacttaacatttattgcacaactcacttcaggccactggtgacatcccaaaacacagcctagt

SEQ ID NO: 302644 - DNA, 1123 bp, Homo sapiens
agaggccacacggccgggcggggcgtgagggacagcccgaggactacaggtcccaaggttccccgcgccgcttccggggcacggtggcgtcccggcaccgcggccgcagtgaggagactcggccatgctacgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgccagaccgtgcgcgccctcaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggatagcgaggctgcggcaggaggagcgggagcaggagcagcggcaggcgttggagcaggcccgcaaggccgaagaggtgcaggcctgggcgcagcgcaaggagcgggaagtgctgcagctgcaggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacaca

SEQ ID NO: 302645 - DNA, 1340 bp, Homo sapiens
agaggccacacggccgggcggggcgtgagggacagcccgaggactacaggtcccaaggttccccgcgccgcttccggggcacggtggcgtcccggcaccgcggccgcagtgaggagactcggccatgctacgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgccagaccgtgcgcgccctcaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggatagcgaggctgcggcaggaggagcgggagcaggagcagcggcaggcgttggagcaggcccgcaaggccgaagaggtgcaggcctgggcgcagcgcaaggagcgggaagtgctgcagctgcaggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacacaaaaaaaaacgacaaaaaaactcagaggaaaccaacgccaggatgaggaaacagagaggaacggaaagggaacagggacatagcaggaaaccgtgacccagagtttactaggtacacaaggggttagagtttagagggtgtccccaataacatgcgctccagaatagaattacgaatagagccagggttaaccgtgcgttaggaatcagggccaaaac

SEQ ID NO: 302646 - DNA, 1015 bp, Homo sapiens
ctcctcgtctgtccatctctcccccacacttatgctaggtcgaggctgggtgttaatcggccgactcggccatgctacgcgcgctgagccgcctgggcgcggggaccccgtgcaggccccgggcccctctggtgctgccagcgcgcggccgcaagacccgccacgacccgctggccaaatccaagatcgacgttaccagcactaccgccagaccgtgcgcgccctcaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggatagcgaggctgcggcaggaggagcgggagcaggagcagcggcaggcgttggagcaggcccgcaaggccgaagaggtgcaggcctgggcgcagcgcaaggagcgggaagtgctgcagctgcaggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacaca

SEQ ID NO: 302647 - DNA, 505 bp, Homo sapiens
tcagacgctgaactatgtggtgggggatgagccggatgccagctgggacgaggcccttgtaaaaggccagaggcccgagcttcgctgtctccacggcgcagtggaaaacgccctgatactcccccttggagttcatcaggcgagtcttcagcacatccaggggctggcacaggaacgtggcaacatccacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacaca

SEQ ID NO: 302648 - DNA, 452 bp, Homo sapiens
gtaaagagtgactgctcatagagacggggtatctttagggaggatgagaatgttagctagtggtggtggtcgcacaaccttggaaataaactaaaaaccactgaagtattcactttaagcagatgaattatatggcatgtgaattatatctcaataaagcttacctcaaggattgagggtctttggtaggggccgatatctaaaacagtgtgcctgtagcttaaggccttagtgcacatacacattcttatgaattagcacttctttgctgcctcttagggcttaaccactgacggaaactgtcttgtgtgcttgcacttttctggtttgtcttctgacctctgactcctttcctggaagaccagcatcaagaaagcacaaggcagatctgtggttcatctctgccctgttgtgggattggcacaccgtagatactagggagcttctttttt

SEQ ID NO: 302649 - DNA, 639 bp, Homo sapiens
gggggccgccacgtgcgggacctgccctggcgttggggtgtggggtcccctagcctggagcgggctcgtcctggcgggcctggatccaagcacaatctcagcttttggagccagcagccggaccgaattcagtttttccggagttcagttgttatgacccaagtttagccgacaggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaatatcggtaagttgttttagtatcat

SEQ ID NO: 302650 - DNA, 469 bp, Homo sapiens
  misc_feature (27)..(27): n is a, c, g, or t
tacgccggtaccacatctgacgtccancaggaagcaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaatatcggtaagttgttttagtatcat

SEQ ID NO: 302651 - DNA, 496 bp, Homo sapiens
  misc_feature (22)..(22): n is a, c, g, or t
ctagctgaacgacttttaattncaccgctcaggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaatatcggtaagttgttttagtatcat

SEQ ID NO: 302652 - DNA, 500 bp, Homo sapiens
gccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggtgtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaatatcggtaagttgttttagtatcat

SEQ ID NO: 302653 - DNA, 1131 bp, Homo sapiens
tctccctctcagttgagccaaagcatctgtgctcatttgtttttagatttcttaaaggatttcatttgaaagaaaaaagaaacaagtccatgagaccactgtcctgtgaacgtgaactactttctatttgggtaggtaggaagaagtgaggatagttgcaaagttataatttcattccccttccccacccagaaaaatagaactgagagtcttaaaacatggaatctggctgtagcttggccacagttacctatgtctctttagcatagcctcctggatctcagctttatctctaagaaaatgatatagattagtcacatggtccttctaattgcctgaaatcccactataaatttctagcacctgtcacgcaataggtacttaagaaatgttggtgatggtgtttgaactgaggctccactctgatgaaactgtaaagctcaccttccagcctggtaggttgtcacctgtgtaatataaagctggttctttgagggcaaaaggggattctacttgaatgtagctgcagccttatgtacagcaactaccataatgcagtttgtataccgcaggccccatgtggagacacatactggatgggttctttctcgtatgttacatgggaatgccgacagctgtgttttaattgtgtttgacctatgttttcgttgtagggaagcagaaatgagaaacagtatcttagcccaagttctggatcagtcggcccgggccaggtgtaagcatctttgatttcatttccataaagttagcttgagttagttgaatggggtgattagataccattattgctatcactagatgaaatatttgcttaggctgaaaacacttgagatgtgtaagaagtgtgaagtttataaacctagagaactgtactttaatccctagtaaaagtaccaggtcacttctcttaccaagatgttctccaggtgtgtattaggtaagatttataggaaacaactcatagggccaatcacaaaatgttgctggtagttgacattttgtgtcaactggtgatggggactggggatgggggacttagaggtttttttatgtattgtcagttttagtgtatgttcagagttgttcatcataaaaaccaaaacctgtaga

SEQ ID NO: 302654 - DNA, 787 bp, Homo sapiens
gccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacaggtatgggctggaaacgtgaactttttgaagggtggtttcaccaaatggatttcttttgctgtagttattttaagcaggtgtgtgactcagatttttttgttttgctggaatggtgatttggccaaaatcatccgcagggtatcttcattattgttaaataaacacgtgtgcagctccacatcagaccttgtattgcaattactggttgatgtttctctgctacaatgtgagtaccttaaaaatgagcctgataataggcagctgtggcagtttcctcggctgtgggggtgacgtgagtccggtgcctcacttagtaagtgctcaataagtgttaactggtaagctattctgattgttttatcccaacacagcgcacagcacctgagacagatgcaggtaattgattcggtggcaggtttattgaatgagtatgtgattaccctatcatgctatcattttttaaaaattgtggttaaataaaatttcaccatcacaaccatttttaagtgtgctcttcagtagtgttcacactctagaatgttttcatcttgcaagactgaaacctttagctactggacaattctctatttccccttcctcaccttcttactcctcctctcc

SEQ ID NO: 302655 - DNA, 618 bp, Homo sapiens
gccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatcacgctgtcgccctggaggttctcctccccgccctgcgctcacgacacaccgacatattataaa

SEQ ID NO: 302656 - DNA, 589 bp, Homo sapiens
gcggccgcctactactactactactgctcgaattcaagcttctaacgatgtacggggccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaatatcggtaagttgttttagtatcat

SEQ ID NO: 302657 - DNA, 2373 bp, Homo sapiens
tctccctctcagttgagccaaagcatctgtgctcatttgtttttagatttcttaaaggatttcatttgaaagaaaaaagaaacaagtccatgagaccactgtcctgtgaacgtgaactactttctatttgggtaggtaggaagaagtgaggatagttgcaaagttataatttcattccccttccccacccagaaaaatagaactgagagtcttaaaacatggaatctggctgtagcttggccacagttacctatgtctctttagcatagcctcctggatctcagctttatctctaagaaaatgatatagattagtcacatggtccttctaattgcctgaaatcccactataaatttctagcacctgtcacgcaataggtacttaagaaatgttggtgatggtgtttgaactgaggctccactctgatgaaactgtaaagctcaccttccagcctggtaggttgtcacctgtgtaatataaagctggttctttgagggcaaaaggggattctacttgaatgtagctgcagccttatgtacagcaactaccataatgcagtttgtataccgcaggccccatgtggagacacatactggatgggttctttctcgtatgttacatgggaatgccgacagctgtgttttaattgtgtttgacctatgttttcgttgtagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtaagcttagacagccttgaggaactttactgttacctgctttatcaaaacatggcttcaaaaggtcagctgcatcttcactggattacagaattcttgctgactctcagaagaaattgttggagagaatagtcatacctactttaaaagagaataaattgcctttcctaaattcctctgcttcgctcctttcctggcgttgctctggaaccttgttggtgtctgtgacccaatgactgttagggtcagctagcttcaattgcccctgcactggaagcaaggtttgtcagtaacaccaattaaaatactaccagtgtaagtagaaggtgtgttttgcagatgagaaggtgctaagatgccttgcttatgttctctgtgttgctgtaataccatgaggggtatgttgtggcaaacctggcctttgagatcaagacgaaccccacctgccctgagaagccgtctgctaccaccacagcctacccgaattggtcctgtcccctaaacccctcacactgagaactgcttgtgtgggagagagctggttgggttgatcttttccgagtgtgacttacctccttcaaggggatgtttaagcttctcgggcagaagtggtgtgtctattcctgacaccaaacaccgtggtatatgtggttgtcacactcagctagtgatgataaaggtgttcttaaatatgttagctttcagttttcctgaggaagcaattttatggatacttccccctccttctcaagtgaggaatagcagagcaaattttatttggaacttaaaccaatagttataaccaatagtttcaacctcctgcctcaccactgcttccttcctgagctctttccccacacctcaaaaagagtacaaagtgattccatctgcagaggtaaattctttgtttaaaaaagtactgtttttcttatcttttctggttctcctaggtatcagaacaaggtttaatagaaatccttaaaaaagtaagccaacaaacagaaaagacaacaacagtgaaagtaagtgtccccagatgcttgtggcaaatgaaaagatggatactttaaagattaatgttgagtatacatctaccacacatatttttcagcccagagacattttccttttgtcaaacacgtgaaagtttggggagaaaggctgaatctgttgggggagggttctaatttttataggctcttgactccattcccacccttttagttcacgctaagttgctttaaagacacaaatgtcttgctaaaattggtagaaatcttttctcggaaaatctgagttatgctttattagaaatgttctgacactcatttaattttcctcccagttcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaatatcggtaagttgttttagtatcat

SEQ ID NO: 302658 - DNA, 1685 bp, Homo sapiens
tgcatttgattttaatggattttttgcatatgtattttttctttttagtaagtaacttagcacttgtaaagcctgaaaaaactaaagcagtagagaattaccttatacagatggcaagatatggacaactaagtgagaaggtaagcttagacagccttgaggaactttactgttacctgctttatcaaaacatggcttcaaaaggtcagctgcatcttcactggattacagaattcttgctgactctcagaagaaattgttggagagaatagtcatacctactttaaaagagaataaattgcctttcctaaattcctctgcttcgctcctttcctggcgttgctctggaaccttgttggtgtctgtgacccaatgactgttagggtcagctagcttcaattgcccctgcactggaagcaaggtttgtcagtaacaccaattaaaatactaccagtgtaagtagaaggtgtgttttgcagatgagaaggtgctaagatgccttgcttatgttctctgtgttgctgtaataccatgaggggtatgttgtggcaaacctggcctttgagatcaagacgaaccccacctgccctgagaagccgtctgctaccaccacagcctacccgaattggtcctgtcccctaaacccctcacactgagaactgcttgtgtgggagagagctggttgggttgatcttttccgagtgtgacttacctccttcaaggggatgtttaagcttctcgggcagaagtggtgtgtctattcctgacaccaaacaccgtggtatatgtggttgtcacactcagctagtgatgataaaggtgttcttaaatatgttagctttcagttttcctgaggaagcaattttatggatacttccccctccttctcaagtgaggaatagcagagcaaattttatttggaacttaaaccaatagttataaccaatagtttcaacctcctgcctcaccactgcttccttcctgagctctttccccacacctcaaaaagagtacaaagtgattccatctgcagaggtaaattctttgtttaaaaaagtactgtttttcttatcttttctggttctcctaggtatcagaacaaggtttaatagaaatccttaaaaaagtaagccaacaaacagaaaagacaacaacagtgaaagtaagtgtccccagatgcttgtggcaaatgaaaagatggatactttaaagattaatgttgagtatacatctaccacacatatttttcagcccagagacattttccttttgtcaaacacgtgaaagtttggggagaaaggctgaatctgttgggggagggttctaatttttataggctcttgactccattcccacccttttagttcacgctaagttgctttaaagacacaaatgtcttgctaaaattggtagaaatcttttctcggaaaatctgagttatgctttattagaaatgttctgacactcatttaattttcctcccagttcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaatatcggtaagttgttttagtatcat

SEQ ID NO: 302659 - DNA, 1742 bp, Homo sapiens
  misc_feature (27)..(27): n is a, c, g, or t
tacgccggtaccacatctgacgtccancaggaagcaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtaagcttagacagccttgaggaactttactgttacctgctttatcaaaacatggcttcaaaaggtcagctgcatcttcactggattacagaattcttgctgactctcagaagaaattgttggagagaatagtcatacctactttaaaagagaataaattgcctttcctaaattcctctgcttcgctcctttcctggcgttgctctggaaccttgttggtgtctgtgacccaatgactgttagggtcagctagcttcaattgcccctgcactggaagcaaggtttgtcagtaacaccaattaaaatactaccagtgtaagtagaaggtgtgttttgcagatgagaaggtgctaagatgccttgcttatgttctctgtgttgctgtaataccatgaggggtatgttgtggcaaacctggcctttgagatcaagacgaaccccacctgccctgagaagccgtctgctaccaccacagcctacccgaattggtcctgtcccctaaacccctcacactgagaactgcttgtgtgggagagagctggttgggttgatcttttccgagtgtgacttacctccttcaaggggatgtttaagcttctcgggcagaagtggtgtgtctattcctgacaccaaacaccgtggtatatgtggttgtcacactcagctagtgatgataaaggtgttcttaaatatgttagctttcagttttcctgaggaagcaattttatggatacttccccctccttctcaagtgaggaatagcagagcaaattttatttggaacttaaaccaatagttataaccaatagtttcaacctcctgcctcaccactgcttccttcctgagctctttccccacacctcaaaaagagtacaaagtgattccatctgcagaggtaaattctttgtttaaaaaagtactgtttttcttatcttttctggttctcctaggtatcagaacaaggtttaatagaaatccttaaaaaagtaagccaacaaacagaaaagacaacaacagtgaaagtaagtgtccccagatgcttgtggcaaatgaaaagatggatactttaaagattaatgttgagtatacatctaccacacatatttttcagcccagagacattttccttttgtcaaacacgtgaaagtttggggagaaaggctgaatctgttgggggagggttctaatttttataggctcttgactccattcccacccttttagttcacgctaagttgctttaaagacacaaatgtcttgctaaaattggtagaaatcttttctcggaaaatctgagttatgctttattagaaatgttctgacactcatttaattttcctcccagttcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaatatcggtaagttgttttagtatcat

SEQ ID NO: 302660 - DNA, 751 bp, Homo sapiens
agggtcggaggaacgcttgccccgccgggatgacagggaggggccgcctgggaagcttggatggatcacacgcccggagaggcgtttctgataagggaccgggaccttagggacggagggcgcagtctttgagttatcgttgtccctaataccgaggcccgttttattttccagaaattattcctacatgtgaaacacggtttcgtaatacagggattcccctccccagggtgctctgtattccaaagccttctgaggttgtggttttagacgttcatcaaaacgttgatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaatatcggtaagttgttttagtatcat

SEQ ID NO: 302661 - DNA, 1542 bp, Homo sapiens
gccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtaagcttagacagccttgaggaactttactgttacctgctttatcaaaacatggcttcaaaaggtcagctgcatcttcactggattacagaattcttgctgactctcagaagaaattgttggagagaatagtcatacctactttaaaagagaataaattgcctttcctaaattcctctgcttcgctcctttcctggcgttgctctggaaccttgttggtgtctgtgacccaatgactgttagggtcagctagcttcaattgcccctgcactggaagcaaggtttgtcagtaacaccaattaaaatactaccagtgtaagtagaaggtgtgttttgcagatgagaaggtgctaagatgccttgcttatgttctctgtgttgctgtaataccatgaggggtatgttgtggcaaacctggcctttgagatcaagacgaaccccacctgccctgagaagccgtctgctaccaccacagcctacccgaattggtcctgtcccctaaacccctcacactgagaactgcttgtgtgggagagagctggttgggttgatcttttccgagtgtgacttacctccttcaaggggatgtttaagcttctcgggcagaagtggtgtgtctattcctgacaccaaacaccgtggtatatgtggttgtcacactcagctagtgatgataaaggtgttcttaaatatgttagctttcagttttcctgaggaagcaattttatggatacttccccctccttctcaagtgaggaatagcagagcaaattttatttggaacttaaaccaatagttataaccaatagtttcaacctcctgcctcaccactgcttccttcctgagctctttccccacacctcaaaaagagtacaaagtgattccatctgcagaggtaaattctttgtttaaaaaagtactgtttttcttatcttttctggttctcctaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaatatcggtaagttgttttagtatcat

SEQ ID NO: 302662 - DNA, 592 bp, Homo sapiens
gccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaatatcggtaagttgttttagtatcat

SEQ ID NO: 302663 - DNA, 509 bp, Homo sapiens
cttcaacccactgcttcctgactcgctctactccgtggaaggacgctcacaaaggcacgtgggccgtggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 302664 - DNA, 614 bp, Homo sapiens
  misc_feature (556)..(556): n is a, c, g, or t
gccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttaatngatgcggccggaattatttatataaaataaagcacctacgactgcccgcgccgacccc

SEQ ID NO: 302665 - DNA, 1865 bp, Homo sapiens
gccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtaagcttagacagccttgaggaactttactgttacctgctttatcaaaacatggcttcaaaaggtcagctgcatcttcactggattacagaattcttgctgactctcagaagaaattgttggagagaatagtcatacctactttaaaagagaataaattgcctttcctaaattcctctgcttcgctcctttcctggcgttgctctggaaccttgttggtgtctgtgacccaatgactgttagggtcagctagcttcaattgcccctgcactggaagcaaggtttgtcagtaacaccaattaaaatactaccagtgtaagtagaaggtgtgttttgcagatgagaaggtgctaagatgccttgcttatgttctctgtgttgctgtaataccatgaggggtatgttgtggcaaacctggcctttgagatcaagacgaaccccacctgccctgagaagccgtctgctaccaccacagcctacccgaattggtcctgtcccctaaacccctcacactgagaactgcttgtgtgggagagagctggttgggttgatcttttccgagtgtgacttacctccttcaaggggatgtttaagcttctcgggcagaagtggtgtgtctattcctgacaccaaacaccgtggtatatgtggttgtcacactcagctagtgatgataaaggtgttcttaaatatgttagctttcagttttcctgaggaagcaattttatggatacttccccctccttctcaagtgaggaatagcagagcaaattttatttggaacttaaaccaatagttataaccaatagtttcaacctcctgcctcaccactgcttccttcctgagctctttccccacacctcaaaaagagtacaaagtgattccatctgcagaggtaaattctttgtttaaaaaagtactgtttttcttatcttttctggttctcctaggtatcagaacaaggtttaatagaaatccttaaaaaagtaagccaacaaacagaaaagacaacaacagtgaaagtaagtgtccccagatgcttgtggcaaatgaaaagatggatactttaaagattaatgttgagtatacatctaccacacatatttttcagcccagagacattttccttttgtcaaacacgtgaaagtttggggagaaaggctgaatctgttgggggagggttctaatttttataggctcttgactccattcccacccttttagttcacgctaagttgctttaaagacacaaatgtcttgctaaaattggtagaaatcttttctcggaaaatctgagttatgctttattagaaatgttctgacactcatttaattttcctcccagttcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaatatcggtaagttgttttagtatcat

SEQ ID NO: 302666 - DNA, 1105 bp, Homo sapiens
gcggccaccgttttaaccacgattggcgaagcgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaaaaaaagtgagttggaaaaaaaagtcgaaa

SEQ ID NO: 302667 - DNA, 894 bp, Homo sapiens
ccgttacttacagtgtgcttcaccctgcgatacgataatccagaatttacaaacttcatcgttcggcttgacgaccaaaaaatcaggcactactctgattgatcatcgcaggaatttacgaacacatccacagtagccacgggcccctcttctttcaaccgtctcgcatacatgttaaccgtcctttcatcattcaacgatcgtcatcgtctctaacgatcgtggtctgctggtttagctgttagacttgactatcgagattatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaa

SEQ ID NO: 302668 - DNA, 425 bp, Homo sapiens
ttttacagactgaatacttgggaggaaataaataaatggccttaaatgtaaaaattatgtattgaagcagtgttcttttctcataaaacaatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaa

SEQ ID NO: 302669 - DNA, 1076 bp, Homo sapiens
gcggccaccgttttaaccacgattggcgaagcgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaa

SEQ ID NO: 302670 - DNA, 1051 bp, Homo sapiens
cggattccgcaccaaggctcgtgccggaacggctggccggccttttggcggggtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaa

SEQ ID NO: 302671 - DNA, 1206 bp, Homo sapiens
gcggccaccgttttaaccacgattggcgaagcgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaagtcgaccaaccaccccccccaccccccccacaaaaaaacccggggcttttttcgcgggggccaaacaggttaagcgcacgccacgttttccccccttttttgcacaggggaaaacggcccctaaggggca

SEQ ID NO: 302672 - DNA, 1365 bp, Homo sapiens
  misc_feature (1077)..(1077): n is a, c, g, or t
gcggccaccgttttaaccacgattggcgaagcgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaanaaaacacacaaacaccacaaaccaaccccaaacaacacttgggggggcgccacgggcctggaaaaaaaggtttcaaaaccccattcctggggggccccgcggccaagtgaggtaattgaacactgggcacacgtggtccaaagaaacacccggcactgagacacagggcgggtctcccaccaataaaaaacggcggggggcgaccggcggttcgcaacaatccagagggggtccgcggctcacgggtctcacacgggatcaggaggctatacccacgccgccacggga

SEQ ID NO: 302673 - DNA, 1588 bp, Homo sapiens
gcggccaccgttttaaccacgattggcgaagcgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaaaaaaaaaaagtaaaaaaaacaagagaaaatacaaagggggggggggagacactaaagagaaatcccgagagggggcgcaagataaggcggaaccaagtttattatgtgcacaaaggggcgccactaatagagaggcgagataatagagaagagggacagagcacaagagagaaaaacacaggcagaagagagtggggcaacaaggtgggtgatatggttgagggacacatcttgtgggaggagggaaccccttatatagtagggggggaggagaaggggacaaaataataggtgggggagcaaaatattaccacctaagagaagagtatttgaagcacccatgagggggaaacataaatagacaatgttgaagagggtgaattcaatggctgttaaaaacagatcgtgggaattatggtatggagagcttagaaaaaatatgtagaagaaaggtagatattgtgtttaaggacaatttttttaatcagagggtaggatgagtagaatataag

SEQ ID NO: 302674 - DNA, 1289 bp, Homo sapiens
gcggccaccgttttaaccacgattggcgaagcgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaaaaatatcaataattatatctacctacacttcactcatcttcacccccctctcccctctcttccttccctctatacctctcctcatttaccttctatccctcccttccccttactgccctctcttctctacccctcctctttctttctctccattttttgtcctcccctccccctcctattttcatctccttccttcttgtttcctcctcctcc

SEQ ID NO: 302675 - DNA, 1124 bp, Homo sapiens
  misc_feature (137)..(137): n is a, c, g, or t
  misc_feature (139)..(139): n is a, c, g, or t
  misc_feature (142)..(142): n is a, c, g, or t
gtctcgtgtcgtcgtgttgtgttgtctgcttgttgcttgtgtcgtgcttgttctgtttctgctgtcgtcgttctttctcgcgcttcttcgttccttgctgtggtcgtcttttttgtttgtctttctgctgtgtctcncnagntgtttggtcttagtcccgaccgcgcgccatccccgtcccaccggtgttctttgtttggtgaatcgtgggtttccctccccgcgtgcgctattttggcgcggattttctagctcgagggtcggtgtgtcccccccccgtggttcctcgcatgtcccacgttaaacctcctgtgcttaaacccaaactcgccctccaagtgaaacagaggattaagaacatcccacaccaccgactgccccagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaa

SEQ ID NO: 302676 - DNA, 981 bp, Homo sapiens
gcggccaccgttttaaccacgattggcgaagcgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgacttctggcatgtttggaaatcaaaatgtcacattctcgggggaggaagcccagaaaattgggtatgttctagagatttaccaccattgcttattgcttttttctttaataaagtttaggaaagtagaa

SEQ ID NO: 302677 - DNA, 718 bp, Homo sapiens
atgggaaagtcggaagatgaacacttgaggacttcagcttctcacctacttagtacagttgggaacattcacctctggtggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaa

SEQ ID NO: 302678 - DNA, 652 bp, Homo sapiens
tatatttttgcctgtttttatagctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaa

SEQ ID NO: 302679 - DNA, 1074 bp, Homo sapiens
gcggccaccgttttaaccacgattggcgaagcgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagcatcccacctccgccccctccgtgcacatcctgtcatctcccagttcattcgtggaaccagacaggccaggcaaccagtggcccccaaaggcaggcaggatcctcaggccccatcctcggaaggctggaagggatggcagatcgcttccctcatccacctccaccggtccaggtttttgatgctgtccccagacctcgtgtcacaccacgccagatcacagggcaccaggccagagatagttttctttttgtcctttctggcctctgggtagtcagtttttcatagccttccagtatctggctttgtattgagaaataaaacacattttcata

SEQ ID NO: 302680 - DNA, 1088 bp, Homo sapiens
tctcgtttccgttttccttctttttgcgttgtccttgtcttttccttccccttccatttttttaaaatttgatttttaagtgtgtatggatacttgcatgcatgcctaccataatgaaatgccttggtgattaaaaccaccaacggtgtcctttgaaaggtttgaaaatattttactagagtgaagtgataaaagcaaagtgtaagacagtatgtatgatctgctaccctttgtgtcaaaaatgtgtattcgtgctaagcatgctcgtcatttcgcagttttagtgagggtaaggaatctgtaggggatcgcaaggctcaggtaggaaggagacctactttttaccatgtgtcttgctgtatttaaagttgttttttaccagtcacgtgcattacctattcaaaaaatggttttaattgttgcaagcaccattcaacattattaaaatactagaagtgtgaaaggttacgttatattagtgggttttttttatttttaatttaatggggagtttattaatgaacttaggtaattctgacttcatcaaaatgagcatccttattctctgggctcatagaagaaaggatgacaggtacacagcctataaaaagtaaaaatatttttgggtttcttaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaa

SEQ ID NO: 302681 - DNA, 687 bp, Homo sapiens
taatgacaaggcactgctgcaataaggatatattgttttgtatgcctgggctaaaggattggatgagctatagagcttcctggtacatttaaaggttaacttttccccctaaccggttgaaatagggaaaactcgctaatcacaatcatcacaaagcaaatataaacaaaattcctagttcccttgcccatgcagctaaaagagttaagacaccagaatagctaggtgcttttcagtttcagttgaggaaaggatgctattcttaaccataaatactctcgttttgtctttctttttttaaagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaa

SEQ ID NO: 302682 - DNA, 866 bp, Homo sapiens
tctcgtttccgttttccttctttttgcgttgtccttgtcttttccttccccttccatttttttaaaatttgatttttaagtgtgtatggatacttgcatgcatgcctaccataatgaaatgccttggtgattaaaaccaccaacggtgtcctttgaaaggtttgaaaatattttactagagtgaagtgataaaagcaaagtgtaagacagtatgtatgatctgctaccctttgtgtcaaaaatgtgtattcgtgctaagcatgctcgtcatttcgcagttttagtgagggtaaggaatctgtaggggatcgcaaggctcaggtaggaaggagacctactttttaccatgtgtcttgctgtatttaaagttgttttttaccagtcacgtgcattacctattcaaaaaatggttttaattgttgcaagcaccattcaacattattaaaatactagaagtgtgaaaggttacgttatattagtgggttttttttatttttaatttaatggggagtttattaatgaacttaggtaattctgacttcatcaaaatgagcatccttattctctgggctcatagaagaaaggatgacaggtacacagcctataaaaagtaaaaatatttttgggtttcttaggcaattcggattttggttcaggagcgcctgacacaggatgcagttgctaaggcaaatcaaacaaaagaggtacgtttctataaatcctaaataagttgttaatgaacatttcttctggtatggccatgattttaaactttgcatgtatctgtttaagatatccattctacgttctacaacttagagaaaggatagcttacttcagtgcttcctaaagcaaattgaatgtat

SEQ ID NO: 302683 - DNA, 746 bp, Homo sapiens
ggcttgttctttattccgacaattatgtaaattgccttggaactgttctatagtgatcatgtcagctttaatcataaagtaagtgagaggagagtcagacaatgcatagcgtatttgggatgcttttgttagacttcaaaacccaaggggataaagtataaatcaactacaacaaaatgctataaaattctagtcctgctgcacatttgtcccttttgagttattttaagaggcattcaaacaataacataatatggaaaacatcttagtacgtttgccaagtacaagcatcagtatattaactgtttggcaaccagactatttaataacatctgcaataactgttaaacattgtttgaattcggtttttcaaagatagcatttggttttttatttaaaaattatagtttaagttttcacacttatttttgagttgtaattgtcatcttcctaattaaaattccatttttttaaaatttgatttttaagtgtgtatggatacttgcatgcatgcctaccataatgaaatgccttggtgattaaaaccaccaacggtgtcctttgaaaggtttgaaaatattttactagagtgaagtgataaaagcaaagtgtaagacagtatgtatgatctgctaccctttgtgtcaaaaatgtgtattcgtgctaagcatgctcgtcatttcgcagttttagtgagggtaaggaatctgtaggggatcgcaaggctcaggtaggaaggagaccta

SEQ ID NO: 302684 - DNA, 1027 bp, Homo sapiens
gcggccaccgttttaaccacgattggcgaagcgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaa

SEQ ID NO: 302685 - DNA, 684 bp, Homo sapiens
gcggccaccgttttaaccacgattggcgaagcgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcagggcagttgctaaggcaaatcaaacaaaagagggcttacct

SEQ ID NO: 302686 - DNA, 1853 bp, Homo sapiens
ggggctgcgccgggttccgtgtgtctatgtcaatgtgtctgtccttcactcctccattgtctgccgccactgctgctgctgctgctgctgccgctgctgctgcacgaatcgtcgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatc

SEQ ID NO: 302687 - DNA, 1093 bp, Homo sapiens
caattaatgttatgttgagaatatcaaggcacatttgtggaatttagagttttagacaaaagatagttaacattttttgttgtttttagaaacctgtaggaaattagctaatatgtctattttgtcttaatgtagtagaggaaaaatattactcttgtaatttgggatatactgtgggaaaataagtcgtgatttagtgatggagaaagtgtagaacttcagtttaggtgtgtattactcccacaacatagcccagaagttcctctttatatctaattgctaacatcattattgcatactatctacatttttttcctttgtcatttttctcctaaaaaaagaaaatcccaatctccttaaaagacactggtcatttgaggttactctttaatcaagatatggttgaacttggcaggacccaaaatgttctaaaatgctggaattgctggttcatttgcaaaattacaaaacaattctatttcctaccagcaaattagcactgtgagagatttccaagtcctagtagtgagctataggcttgcattatatcatgcctaagaagatgtatatcatcatcatcagtacttaagcctttagtaagctatcaaaatatggcactatgctacatgaaaatcaacttggttcctctcttctgataagtaacagaatgctttatatttaaaatgattgctttctattaaactgtaatacatgaagttgttttgaaacatgacatttgtatagtaactttgaaatctttgatttaaaattgcagctgatgttctgagcgaagaagcaatactgaaatggtataaggaagcacatgttgctaaaggcaaaagtgtttttcttgaccagatgaagaaatttgttgagtggttacaaaatgcagaagaaggtatgattctgtttacaaacattgatgacctttaaacactgtctcattatatgtcaaaatatttacctcttccacagattttacttgattttctaaaactaaaattctagagttatctttcgtatcaaacattttgccaacatcttagctttcctttctgaaatcacggcaataaaaatctctacatgtaaaaac

SEQ ID NO: 302688 - DNA, 607 bp, Homo sapiens
gttgtccacctagagtagaatctgtcctgcactttgctctcctccccatcacatcgttgtctaagtggttatatctttaacaccttcatttccgtgatttttactgctatattcttgaatgaatttgttttatcttacgtgtacattttgatcatatttgttcccctaggtcatgatagcatctttgaaatgcttatagttcttatattacagtgtgagcctgtttaactatacacttttattattatagatctatggtgtcattatagtgagtttctattacctacttctgtgtctttttggttgacctaatatttaatggttgttttttttttaggtcttcaataaactcatcaggagatataagtatttggagaaggcatttgaagatgaaatgaaaaaggtaaaaattcaaatataatgcctatctgttttatagtaatgacatgggggtggataaaaattttataagtggccggacacggtggctcacgcctgtaatcccagcactttgggaggccgagacgggtgggtcacaaggtcaggagtttaagaccagcctggccaagatgctgaaaccctgtctctactaaaaacacaaaaatta

SEQ ID NO: 302689 - DNA, 1915 bp, Homo sapiens
  misc_feature (1903)..(1903): n is a, c, g, or t
ggggctgcgccgggttccgtgtgtctatgtcaatgtgtctgtccttcactcctccattgtctgccgccactgctgctgctgctgctgctgccgctgctgctgcacgaatcgtcgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatcaaaaaaaaaaacaaaaaaaacaaaaaaaataaataaaaaaaataaacaanaacaaacaaaaa

SEQ ID NO: 302690 - DNA, 2027 bp, Homo sapiens
  misc_feature (2017)..(2017): n is a, c, g, or t
ggggctgcgccgggttccgtgtgtctatgtcaatgtgtctgtccttcactcctccattgtctgccgccactgctgctgctgctgctgctgccgctgctgctgcacgaatcgtcgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatcaaaggaattccatgacatttaccaagaagatcaacaaagactgtaggtcttgtgtttcttcatgcctaaaatttgaagaccaatttaaattctctggtttttctgcttgggtggttggtagaggttagtcttttcatttagatgataaggttgttgtatatggnttatcagaat

SEQ ID NO: 302691 - DNA, 1834 bp, Homo sapiens
ggggctgcgccgggttccgtgtgtctatgtcaatgtgtctgtccttcactcctccattgtctgccgccactgctgctgctgctgctgctgccgctgctgctgcacgaatcgtcgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatc

SEQ ID NO: 302692 - DNA, 1719 bp, Homo sapiens
tagacaggagcagtcattcccttgtagggacaactagaagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatc

SEQ ID NO: 302693 - DNA, 1717 bp, Homo sapiens
ggggctgcgccgggttccgtgtgtctatgtcaatgtgtctgtccttcactcctccattgtctgccgccactgctgctgctgctgctgctgccgctgctgctgcacgaatcgtcgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatc

SEQ ID NO: 302694 - DNA, 1358 bp, Homo sapiens
caattaatgttatgttgagaatatcaaggcacatttgtggaatttagagttttagacaaaagatagttaacattttttgttgtttttagaaacctgtaggaaattagctaatatgtctattttgtcttaatgtagtagaggaaaaatattactcttgtaatttgggatatactgtgggaaaataagtcgtgatttagtgatggagaaagtgtagaacttcagtttaggtgtgtattactcccacaacatagcccagaagttcctctttatatctaattgctaacatcattattgcatactatctacatttttttcctttgtcatttttctcctaaaaaaagaaaatcccaatctccttaaaagacactggtcatttgaggttactctttaatcaagatatggttgaacttggcaggacccaaaatgttctaaaatgctggaattgctggttcatttgcaaaattacaaaacaattctatttcctaccagcaaattagcactgtgagagatttccaagtcctagtagtgagctataggcttgcattatatcatgcctaagaagatgtatatcatcatcatcagtacttaagcctttagtaagctatcaaaatatggcactatgctacatgaaaatcaacttggttcctctcttctgataagtaacagaatgctttatatttaaaatgattgctttctattaaactgtaatacatgaagttgttttgaaacatgacatttgtatagtaactttgaaatctttgatttaaaattgcagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatc

SEQ ID NO: 302695 - DNA, 633 bp, Homo sapiens
  misc_feature (148)..(148): n is a, c, g, or t
  misc_feature (162)..(162): n is a, c, g, or t
cggaacgttgaggccaatatgacgtgaagtcgtggaagcctgtggctacaaaaaatgttgagccgtcaatccgtcggaaatggtgaagggagactcgaagtactctgaggcttgtaggagggtaaaatagagacccagtaaaattgtngagtggttacaaantgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatc

SEQ ID NO: 302696 - DNA, 799 bp, Homo sapiens
aggtgatccaaagaagaaaagttatattgtttaattttatatatattcaaatttttatataatttatatgtataaatttaatatatataaaatgtattcatttataggtatttgtatatgtatgcatgttgcatttttagacaggcaaaatttacgtgaaagcagaaaagagcaagagtttgctatctgccctcatgtgactattttaccttataatgggtgcctagggtaaaagtatgctggcgcaatggcagggttctgggttggtgactgtagtaacttttgaccttaattagaggaatctgggaggaaatatctcacttctttcttctctcctagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatc

SEQ ID NO: 302697 - DNA, 591 bp, Homo sapiens
  misc_feature (106)..(106): n is a, c, g, or t
  misc_feature (120)..(120): n is a, c, g, or t
cttatgcatagggtgtgggtcttcgaaacagagattcatagaatttgaaatggacgaaagatgtgcacaattaagataaaataaaagggagatgaagatgtgtgtngagtggttacaaantgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatc

SEQ ID NO: 302698 - DNA, 2386 bp, Homo sapiens
  misc_feature (1108)..(1108): n is a, c, g, or t
  misc_feature (1693)..(1693): n is a, c, g, or t
ggggctgcgccgggttccgtgtgtctatgtcaatgtgtctgtccttcactcctccattgtctgccgccactgctgctgctgctgctgctgccgctgctgctgcacgaatcgtcgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggtaacgaggctcctgttttctcgcctgtcagacaacaaaagaaaaataaagtcacagatagttagaaaaatgccagtggctctttttggtgtcctctattactcattcttcatttaagagaatatctttgtatgggtgtatattgcctttcaaataataaaaggagtggacttgttaattgtaggaagtttgaaggaaaaaatatgcacacctgtacaaagacatattaagaaagactaatagcaaattaaaatctcatggaagacttgatgcctaggtcaaataccccgaaatcgatctggtaatctttttgcccttcgacacaaaatggcagcctttaactttcacccctattataagaacaaaaactgttcccctctcaaggtctagagaaactgatgctcngatattcattttgattgcactttttaagatactcattgtctcagttttagaaaacaattttaagtctgctgcattagaaggagtcttgttttaattttaaggcattaagggttggataggcatgcataccatggtttggttatagaataaaataaaagtcggctgtttacttgtaggaggataatgatagtcaaattacaatgcaacacaaaacagttatttttccttaaaaataaattaaaagagcttttgtgagaacatctgtttcttctgagaacttaaagttttcctcctacatatatgaagtcctagcttcattcatgcctatagtgaaagaaaggagtcatagttttcttgtagctaaggaaagaatagtaaattgagagtcaattggtcttattcagagactcttcctagtttttagcttaaaatcactcagatttatgacaattcagactctgtaattgttagatgttattagtattatgacattttaaagtatttccctgaagaaaattcacaatacaacacacatcttatttttgctattagccattttgcacacagaaagtcaacatagaatanaaatgttaatcattaattattttaaattatcctagccaacataacagaaaataattgcctttctagtttttttaaaaacctaagtgatgtctgtaacttcctttgtaatatatccaaaaattacgttattaggtggatagatatctgataaagcaaatacggcaaaatattagttatagaaactagatggtgggcatgtgaatgttcattgttcaatttgttcaacttttctgtatgtctggaaattattgtagtaaaatgtttggggggtggtgaggagaaaaataactttgctatggaagtaacatagtacctctgttatatggcttttccttaaactctgccatcttttacaaactagaggtttaaacccttgcttcctaattggaaaaggattaagaaaatgctgggtatggtaactcatgcctgtaatcctaacactttgggaagctgaggtaaaaaaattgcttgaggccaggagtttgagaccagtctgggaaacaaagcaagactctcttctctacaaaaaaaaatttaaaaactagccaggtgtgttggcacacctgtacaatcccagctgctcaggagactaaggcaagaggattgcttgagcccaggagtttggggctacagtgagctataatcacatcatcttactacagcctgggcaacagagaaagactatctaaaata

SEQ ID NO: 302699 - DNA, 589 bp, Homo sapiens
ggggctgcgccgggttccgtgtgtctatgtcaatgtgtctgtccttcactcctccattgtctgccgccactgctgctgctgctgctgctgccgctgctgctgcacgaatcgtcgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcagcttcaataaactcatcaggagatttaaggaagaggagaagctttttcatttcatcttcaaatgccttctccaaatacttatatgtcga

SEQ ID NO: 302700 - DNA, 220 bp, Homo sapiens
aaattttatgaataagcatcagaagccagtgctaacaggccagcggttcaaaactcggaaaaggggtaggttgtgtgtgtgtgtgtgtgtgtgtttaaagttgtaaccaaaatataagattggagaagaatctgaatgatccctgtttcccccagcctcactgattctactcatttgagctctgagtgtagaatctgaagtgctttagtgaaaccataga

SEQ ID NO: 302701 - DNA, 2271 bp, Homo sapiens
  misc_feature (993)..(993): n is a, c, g, or t
  misc_feature (1578)..(1578): n is a, c, g, or t
tagacaggagcagtcattcccttgtagggacaactagaagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggtaacgaggctcctgttttctcgcctgtcagacaacaaaagaaaaataaagtcacagatagttagaaaaatgccagtggctctttttggtgtcctctattactcattcttcatttaagagaatatctttgtatgggtgtatattgcctttcaaataataaaaggagtggacttgttaattgtaggaagtttgaaggaaaaaatatgcacacctgtacaaagacatattaagaaagactaatagcaaattaaaatctcatggaagacttgatgcctaggtcaaataccccgaaatcgatctggtaatctttttgcccttcgacacaaaatggcagcctttaactttcacccctattataagaacaaaaactgttcccctctcaaggtctagagaaactgatgctcngatattcattttgattgcactttttaagatactcattgtctcagttttagaaaacaattttaagtctgctgcattagaaggagtcttgttttaattttaaggcattaagggttggataggcatgcataccatggtttggttatagaataaaataaaagtcggctgtttacttgtaggaggataatgatagtcaaattacaatgcaacacaaaacagttatttttccttaaaaataaattaaaagagcttttgtgagaacatctgtttcttctgagaacttaaagttttcctcctacatatatgaagtcctagcttcattcatgcctatagtgaaagaaaggagtcatagttttcttgtagctaaggaaagaatagtaaattgagagtcaattggtcttattcagagactcttcctagtttttagcttaaaatcactcagatttatgacaattcagactctgtaattgttagatgttattagtattatgacattttaaagtatttccctgaagaaaattcacaatacaacacacatcttatttttgctattagccattttgcacacagaaagtcaacatagaatanaaatgttaatcattaattattttaaattatcctagccaacataacagaaaataattgcctttctagtttttttaaaaacctaagtgatgtctgtaacttcctttgtaatatatccaaaaattacgttattaggtggatagatatctgataaagcaaatacggcaaaatattagttatagaaactagatggtgggcatgtgaatgttcattgttcaatttgttcaacttttctgtatgtctggaaattattgtagtaaaatgtttggggggtggtgaggagaaaaataactttgctatggaagtaacatagtacctctgttatatggcttttccttaaactctgccatcttttacaaactagaggtttaaacccttgcttcctaattggaaaaggattaagaaaatgctgggtatggtaactcatgcctgtaatcctaacactttgggaagctgaggtaaaaaaattgcttgaggccaggagtttgagaccagtctgggaaacaaagcaagactctcttctctacaaaaaaaaatttaaaaactagccaggtgtgttggcacacctgtacaatcccagctgctcaggagactaaggcaagaggattgcttgagcccaggagtttggggctacagtgagctataatcacatcatcttactacagcctgggcaacagagaaagactatctaaaata

SEQ ID NO: 302702 - DNA, 2158 bp, Homo sapiens
ggggctgcgccgggttccgtgtgtctatgtcaatgtgtctgtccttcactcctccattgtctgccgccactgctgctgctgctgctgctgccgctgctgctgcacgaatcgtcgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatcaaagaaaaaagaaagaagacaagagaaagaaaagaagagaacacagaaaaaaaaaagaacgtgttaggaggacaacagcaacgcgagagaaaagctaaaaaacacaggtagagcagcgcggggccccaaaaagtacaacgacaaagaggacaaaaaatataacaaaaaagaacctgtgcaacaaacacgcgccgggtaatacacacaaaaaaaaacccccgtgaacacgacagaagtgaacaagaccaacagcagggacgcagagaccaaaggggacaccaagggagcaagaagccacataaaca

SEQ ID NO: 302703 - DNA, 2026 bp, Homo sapiens
ggggctgcgccgggttccgtgtgtctatgtcaatgtgtctgtccttcactcctccattgtctgccgccactgctgctgctgctgctgctgccgctgctgctgcacgaatcgtcgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatcaaacaaaaaaaagggaaaaaaaaaaaaaaatgttgggggggcgggccgaaaaaagttttaaaacattttgggggggggcccaaggatggaatgggtaggtgcaaggaacggtgaaaggggggtccccaaaaaaggggggaggggttgaaaccggggtgggcttggttaagcag

SEQ ID NO: 302704 - DNA, 1738 bp, Homo sapiens
tagacaggagcagtcattcccttgtagggacaactagaagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatc

SEQ ID NO: 302705 - DNA, 1749 bp, Homo sapiens
ggggctgcgccgggttccgtgtgtctatgtcaatgtgtctgtccttcactcctccattgtctgccgccactgctgctgctgctgctgctgccgctgctgctgcacgaatcgtcgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatc

SEQ ID NO: 302706 - DNA, 1799 bp, Homo sapiens
ggggctgcgccgggttccgtgtgtctatgtcaatgtgtctgtccttcactcctccattgtctgccgccactgctgctgctgctgctgctgccgctgctgctgcacgaatcgtcgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatc

SEQ ID NO: 302707 - DNA, 1338 bp, Homo sapiens
  misc_feature (1306)..(1306): n is a, c, g, or t
ggggctgcgccgggttccgtgtgtctatgtcaatgtgtctgtccttcactcctccattgtctgccgccactgctgctgctgctgctgctgccgctgctgctgcacgaatcgtcgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagtcagtattgcttcttcgctcagaacatcagctttantcgtgccgattcggcacgagcggcacgagcct

SEQ ID NO: 302708 - DNA, 908 bp, Homo sapiens
  misc_feature (877)..(877): n is a, c, g, or t
gcgtgacagagcgctttacgacggagttgctttgaggcagtaccggaggagaaagatggcggctaccttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagaggtggccagaatcaaaacaaaaaaaattgggngccccaaattaacacattggggcgaagaagt

SEQ ID NO: 302709 - DNA, 987 bp, Homo sapiens
gcgtgacagagcgctttacgacggagttgctttgaggcagtaccggaggagaaagatggcggctaccttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagaggaaaacaaaaacaaactcgacgttagttggtggacaaaaatatatacccaccctcgatattgtaaggaactccagcattgggtgtacccgcacttgcttgtttgtgagtatgtgtcgttgatagaatagacaatagacacc

SEQ ID NO: 302710 - DNA, 641 bp, Homo sapiens
  misc_feature (24)..(24): n is a, c, g, or t
  misc_feature (42)..(42): n is a, c, g, or t
  misc_feature (50)..(50): n is a, c, g, or t
  misc_feature (62)..(62): n is a, c, g, or t
  misc_feature (67)..(67): n is a, c, g, or t
  misc_feature (96)..(96): n is a, c, g, or t
  misc_feature (104)..(104): n is a, c, g, or t
  misc_feature (111)..(112): n is a, c, g, or t
  misc_feature (114)..(114): n is a, c, g, or t
  misc_feature (131)..(131): n is a, c, g, or t
  misc_feature (158)..(158): n is a, c, g, or t
ctaataaatgcaatgcggccgcantgggttttttattttttntccatttnaacttttttaanggggnctcaaaaattttttgcaaaattttttggncaaggttntttcccnntnaaaaaggtttttttttnaaaacttaataatttaaaacctccccncccccaaaaaaaaaaaccaaaagacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagag

SEQ ID NO: 302711 - DNA, 477 bp, Homo sapiens
ctcagaccaatagcagaatggacaggtgaatgtacgtgtgttggagggaggatacgactggtgactcctctccttctatctggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagagtaaagtttgtcacagagaatctttgtaaattg

SEQ ID NO: 302712 - DNA, 825 bp, Homo sapiens
aattcgcggccgcgtcgacacgacagaagggaagatggcggctaccttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagag

SEQ ID NO: 302713 - DNA, 878 bp, Homo sapiens
gcgtgacagagcgctttacgacggagttgctttgaggcagtaccggaggagaaagatggcggctaccttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagagtaaagtttgtcacagagaatctttgtaaattg

SEQ ID NO: 302714 - DNA, 831 bp, Homo sapiens
gcgtgacagagcgctttacgacggagttgctttgaggcagtaccggaggagaaagatggcggctaccttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttacaccgctgatctggatctatttgaaaagaagccgtctgtcaatttaggtgccgggaaaaaaaacggtc

SEQ ID NO: 302715 - DNA, 610 bp, Homo sapiens
attccctgccatcgaggtcttcccgggtcatcggtaaacgaattccttaaaaagtgcctgtgtggaccagtggaggccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagag

SEQ ID NO: 302716 - DNA, 817 bp, Homo sapiens
gcgtgacagagcgctttacgacggagttgctttgaggcagtaccggaggagaaagatggcggctaccttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagag

SEQ ID NO: 302717 - DNA, 846 bp, Homo sapiens
gcgtgacagagcgctttacgacggagttgctttgaggcagtaccggaggagaaagatggcggctaccttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagag

SEQ ID NO: 302718 - DNA, 4876 bp, Homo sapiens
aatgtaatgaatgtgggaaaaccttttgtcagaagttacacctcactcaacacctaagaactcattcaggagagaaaccctacgaatgtagcgaatgtgggaaaaccttctgccaaaagacacatctcaccctgcaccagaggaatcattcaggagagaggccctatccatgtaacgaatgtgggaaatccttctcccgcaagtctgctctcagtgaccatcagagaactcacacgggagagaagctttataaatgtaatgaatgtgggaaatcctactaccgaaagtctactctgattacacatcagagaacacacacgggagagaagccctatcagtgtagcgagtgtgggaaattcttttctcgggtgtcatacctcactatacattatagaagtcatttagaagagaaaccctatgaatgtaatgaatgtggcaaaaccttcaatttaaattcagccttcattagacatcggaaagtacacacagaagagaaatcccatgaatgtagtgaatgtggaaagttctctcagttgtatctcaccgaccatcatacagctcatttagaagagaaaccctatgaatgtaatgaatgtgggaaaaccttccttgtaaattcagccttcgatgggcaccagccacttccaaaaggggagaaatcctatgaatgtaatgagtgtgggaaaaaattccaccacagatcagccttcaatagccatcagagaattcatagaagaggaaatatgaacgtacttgatgtggaaaatctctgaagtcagatctcaatttttagaaaactctctgaatataatgaatatggggaatccaataggaagtcaaagcgtttatctgagagttcgtgttcctgaacggtgagaagcatttaggcattagagtcattttaatccaaattttcacagagaagaatcccgaagaatgtaacaagaagcaaagccttcagcaagatcatacgactcatcggacactaatttatataggagtgaagttttataaatatttaatatttattttggattcaaattgtatttacatatcagggaatcatacaaaggcaaaatctgtcaatatggtgaatgtggaaaatatattgtcttggaaatttgttgtaaaagccatatttctaatggaaaatcaggtgtttacaggaaagatctcagaggctatgagctctgaataaatcttcattgtataaaatgaagtttttaaattgtcaggagttgatcatgaggacagtagcattaaataagtatatggccgttttttatcatgtcttaaaaatgcaatctaatggtaattctatgcaagtttggaattggatgacttgtgaagaggcagttttcttatttgagtattaggatggcaaaatgtattaagacaggacatattgttggtgagataatatttaataggtataaaatggtaaaatacctagttttctatttagaggaatttacaaatgggtttttaacaaatgcctcattagtacaggaggcagtcgttttgtaaagttttcaactgcatctgagtaagataagattttctaaaagactattttgataaactatacatacataatttggaattgtttaagtctatttcagtgaaagagaacaagcatactgcccatactctaaaatatccccagctctcacaccacccttgttttttaacccataggtttgagtgtgcctagtgccaatattttgtaatttagaaattttattcacaaacttctgtttggtacaaatacagtgtcattgttttgtgcattctcctttttcccagtatttcagaacaaattgattcaagtttctagcagatatttttgatcaattaacttaatgtcctcgctccatttcttgctggaacagtttaggtacctaccacttcttcacatgacacaggggaatcctgattagtcaaaataataatgatttcattctctttgccagtaacttgttttatagtggtcatatgacctgatactgggtaaacaaaacaaagatggacttgttctgggaaaaggtaaaatggtaatcaaatagattgtgttccaggaatgcaaaggtggcttaatattcacaagtcagttgctattatacaccacctgtagaaaagtaatctggcatgcagaacattcttgtggtacaattaatgttcgtttatgatcttagcaaatgatggattgaaagggacttacttaattgcataaagagacttaaactacaacaaacaatatgcttaatgatgaaatagtgaacatttctcctaagattataaaaataagacaaggatatctgctgtcaatgattttattcggcattgttcagaaggacctaaccagaaaactaatgcaaggaagagaaacaaaaggcatagagattagaaaagaagtaaaactttaaaaacgaaaaagaatataaatctctatttgcagatgccatgagtaaatttggtaagttccctgcataaaagttatgcaaaaagcattttatgatataccagcaaaaaacatggaaaatgaaattttgaaaagcaatgccacttcaaagatccctcaagtgcctagagggagaaaatgagttaatatgctttgaagaactgtatccagaaaataaaattacaaaggaggagagggataggattccaggacaatctcaaaactattgctttttcctaaattcattgcaaccttaaaatcctagcaagttctttaatgtaaattaacaagctaattctagaattcatatgcatattcaaaagtcgaataattgtcaaggctatcctgtagaatggacagagaggattgaaatttctaaatatcaagacctgttataaagccatagaaataatgaaggtgttaatttggcacaaggatgaaaaaactgactagtggaacagcatacagattcaaaagtagacccacgtgtataccatcacctgagttttgagaaaggtgacattgaagtgtagtgggggaaagggtgttctttccagtaaatgtactttgccaataaaattttgtaatttgataaaaagttatttggaggtggattgcagatctgaatatgaaatgtgaaagctttacaaagaaatcttaggacagtttgtaatcttggagtaagcaaaggtttattgagacccaaaaagcattaacccataaaattagaacttaatattaaatttgagaacttctatttatcagaaagaccaccagtaagaaaatgaacaggaaatcatggggaggagaagatatttgcagttcatgtatgtgacaacagcaccgagtatagcagaagtgttggcaaactttataaagcaaggcaccagatggtgaaaattttcagctttgtcacaactgctcatctttgctattgtgtgaaagcatccatacaccatgcattaaaaaaaaaatgagcatggctgcttcccagtaaaaccattcacaatcccaggtggcagtctggatttggtctgcactcatagttttctggtccctgatctcgaatatgtaaagagcacctacaaatcaacaagggggaaactggaaaaggcaaaagactttagaggatatccactcactttagaggatatccagacggccaataagcatgaaaagatgtgttagctttattagtaatcagggaaatgcaaacttaaaacatgtagcactgctacccatccatggaaatggttaaaatgaaaagcatgaaaaagcatcacgttttggcaaggatgtaagcaagaggaactgtacactactggtggaattgctcatcgataaaaccattttgaaagctggcactaaaagccaagcatatgtatactgttttacccaaacccagcaaaaatgcatgtgtctgtccaccaaaggacatgcactagaatatttatagcctaaaactgcacaaaacagaactatcttaaggcacatgtgcaatggaatgaataaagaagtggcatatgtccatggaatactgtaaaacagtgagcatgaatgaactagaagtccgtgtaataacgcagctgaatttaacaaaccttgctgaatgaaagactccagacacaaaagccaacatgctgtatgattccttctatataaattataaagacgggcaaaacttgtatacgtggtttaaaattaggatagcagttagccttggccaaggctgaaagggggcatttatctggtgctgggaataatctgtttctaaacctaggtgctaagtatttgagtgtgttttgagctgtgcacttaagatatgtgtatttttctgcatgtgtgttaaactttccataaaagttttctaaaatcacaaatggctaacatttgtgtcgctcatcactctaatcatatttttctagatgtgtatgaatatgctgcacaacaggaattaaatggcagattttgcataattctgtgcaggaaatacatatttatagtaattttgatggcaactactaagatttcctacgctgtccttaaagcttagcataatgtatattttaagtgaaatatttgagaaggttaaagaatcattacatactttgtcatcctatacttttgcatatataaataggtctgagctgcctcttcaataaagaagctaatgtgtaacatttcatatttccctaaacaaattgttttttgcatttctgaattcgggattcatcttaacttttactgtaggggtgacctttcttggcagtgaatgaatataatgctgagttggatttgatggaaaattattttaaaagtattcagctaaatatttgagcaaatctcagatacacagttaacagcccagatgtaagtgagtgaaagaaacaggtcagcaaaactttgcaccattga

SEQ ID NO: 302719 - DNA, 5296 bp, Homo sapiens
aatgtaatgaatgtgggaaaaccttttgtcagaagttacacctcactcaacacctaagaactcattcaggagagaaaccctacgaatgtagcgaatgtgggaaaaccttctgccaaaagacacatctcaccctgcaccagaggaatcattcaggagagaggccctatccatgtaacgaatgtgggaaatccttctcccgcaagtctgctctcagtgaccatcagagaactcacacgggagagaagctttataaatgtaatgaatgtgggaaatcctactaccgaaagtctactctgattacacatcagagaacacacacgggagagaagccctatcagtgtagcgagtgtgggaaattcttttctcgggtgtcatacctcactatacattatagaagtcatttagaagagaaaccctatgaatgtaatgaatgtggcaaaaccttcaatttaaattcagccttcattagacatcggaaagtacacacagaagagaaatcccatgaatgtagtgaatgtggaaagttctctcagttgtatctcaccgaccatcatacagctcatttagaagagaaaccctatgaatgtaatgaatgtgggaaaaccttccttgtaaattcagccttcgatgggcaccagccacttccaaaaggggagaaatcctatgaatgtaatgtatgtggaaagttattcaatgagttgtcatactatactgaacattatagaagtcattcagaagagaaaccttatggatgtagcgaatgtgggaaaaccttttcccataattcatccctcttcagacatcaaagagtacacacaggcgagaaaccctatgaatgttacgaatgtggaaaattcttctctcagaaatcatatctcactatacatcatcgaattcattcaggagagaaaccctatgaatgtagtaaatgtggaaaagtcttctctcggatgtcaaacctcactgtccactacagaagccattcaggagagaaaccctatgaatgtaatgaatgtgggaaagtcttttctcagaagtcatacctcactgtacactatagaactcattcaggagagaaaccctatgaatgtaacgagtgtgggaaaaaattccaccacagatcagccttcaatagccatcagagaattcatagaagaggaaatatgaacgtacttgatgtggaaaatctctgaagtcagatctcaatttttagaaaactctctgaatataatgaatatggggaatccaataggaagtcaaagcgtttatctgagagttcgtgttcctgaacggtgagaagcatttaggcattagagtcattttaatccaaattttcacagagaagaatcccgaagaatgtaacaagaagcaaagccttcagcaagatcatacgactcatcggacactaatttatataggagtgaagttttataaatatttaatatttattttggattcaaattgtatttacatatcagggaatcatacaaaggcaaaatctgtcaatatggtgaatgtggaaaatatattgtcttggaaatttgttgtaaaagccatatttctaatggaaaatcaggtgtttacaggaaagatctcagaggctatgagctctgaataaatcttcattgtataaaatgaagtttttaaattgtcaggagttgatcatgaggacagtagcattaaataagtatatggccgttttttatcatgtcttaaaaatgcaatctaatggtaattctatgcaagtttggaattggatgacttgtgaagaggcagttttcttatttgagtattaggatggcaaaatgtattaagacaggacatattgttggtgagataatatttaataggtataaaatggtaaaatacctagttttctatttagaggaatttacaaatgggtttttaacaaatgcctcattagtacaggaggcagtcgttttgtaaagttttcaactgcatctgagtaagataagattttctaaaagactattttgataaactatacatacataatttggaattgtttaagtctatttcagtgaaagagaacaagcatactgcccatactctaaaatatccccagctctcacaccacccttgttttttaacccataggtttgagtgtgcctagtgccaatattttgtaatttagaaattttattcacaaacttctgtttggtacaaatacagtgtcattgttttgtgcattctcctttttcccagtatttcagaacaaattgattcaagtttctagcagatatttttgatcaattaacttaatgtcctcgctccatttcttgctggaacagtttaggtacctaccacttcttcacatgacacaggggaatcctgattagtcaaaataataatgatttcattctctttgccagtaacttgttttatagtggtcatatgacctgatactgggtaaacaaaacaaagatggacttgttctgggaaaaggtaaaatggtaatcaaatagattgtgttccaggaatgcaaaggtggcttaatattcacaagtcagttgctattatacaccacctgtagaaaagtaatctggcatgcagaacattcttgtggtacaattaatgttcgtttatgatcttagcaaatgatggattgaaagggacttacttaattgcataaagagacttaaactacaacaaacaatatgcttaatgatgaaatagtgaacatttctcctaagattataaaaataagacaaggatatctgctgtcaatgattttattcggcattgttcagaaggacctaaccagaaaactaatgcaaggaagagaaacaaaaggcatagagattagaaaagaagtaaaactttaaaaacgaaaaagaatataaatctctatttgcagatgccatgagtaaatttggtaagttccctgcataaaagttatgcaaaaagcattttatgatataccagcaaaaaacatggaaaatgaaattttgaaaagcaatgccacttcaaagatccctcaagtgcctagagggagaaaatgagttaatatgctttgaagaactgtatccagaaaataaaattacaaaggaggagagggataggattccaggacaatctcaaaactattgctttttcctaaattcattgcaaccttaaaatcctagcaagttctttaatgtaaattaacaagctaattctagaattcatatgcatattcaaaagtcgaataattgtcaaggctatcctgtagaatggacagagaggattgaaatttctaaatatcaagacctgttataaagccatagaaataatgaaggtgttaatttggcacaaggatgaaaaaactgactagtggaacagcatacagattcaaaagtagacccacgtgtataccatcacctgagttttgagaaaggtgacattgaagtgtagtgggggaaagggtgttctttccagtaaatgtactttgccaataaaattttgtaatttgataaaaagttatttggaggtggattgcagatctgaatatgaaatgtgaaagctttacaaagaaatcttaggacagtttgtaatcttggagtaagcaaaggtttattgagacccaaaaagcattaacccataaaattagaacttaatattaaatttgagaacttctatttatcagaaagaccaccagtaagaaaatgaacaggaaatcatggggaggagaagatatttgcagttcatgtatgtgacaacagcaccgagtatagcagaagtgttggcaaactttataaagcaaggcaccagatggtgaaaattttcagctttgtcacaactgctcatctttgctattgtgtgaaagcatccatacaccatgcattaaaaaaaaaatgagcatggctgcttcccagtaaaaccattcacaatcccaggtggcagtctggatttggtctgcactcatagttttctggtccctgatctcgaatatgtaaagagcacctacaaatcaacaagggggaaactggaaaaggcaaaagactttagaggatatccactcactttagaggatatccagacggccaataagcatgaaaagatgtgttagctttattagtaatcagggaaatgcaaacttaaaacatgtagcactgctacccatccatggaaatggttaaaatgaaaagcatgaaaaagcatcacgttttggcaaggatgtaagcaagaggaactgtacactactggtggaattgctcatcgataaaaccattttgaaagctggcactaaaagccaagcatatgtatactgttttacccaaacccagcaaaaatgcatgtgtctgtccaccaaaggacatgcactagaatatttatagcctaaaactgcacaaaacagaactatcttaaggcacatgtgcaatggaatgaataaagaagtggcatatgtccatggaatactgtaaaacagtgagcatgaatgaactagaagtccgtgtaataacgcagctgaatttaacaaaccttgctgaatgaaagactccagacacaaaagccaacatgctgtatgattccttctatataaattataaagacgggcaaaacttgtatacgtggtttaaaattaggatagcagttagccttggccaaggctgaaagggggcatttatctggtgctgggaataatctgtttctaaacctaggtgctaagtatttgagtgtgttttgagctgtgcacttaagatatgtgtatttttctgcatgtgtgttaaactttccataaaagttttctaaaatcacaaatggctaacatttgtgtcgctcatcactctaatcatatttttctagatgtgtatgaatatgctgcacaacaggaattaaatggcagattttgcataattctgtgcaggaaatacatatttatagtaattttgatggcaactactaagatttcctacgctgtccttaaagcttagcataatgtatattttaagtgaaatatttgagaaggttaaagaatcattacatactttgtcatcctatacttttgcatatataaataggtctgagctgcctcttcaataaagaagctaatgtgtaacatttcatatttccctaaacaaattgttttttgcatttctgaattcgggattcatcttaacttttactgtaggggtgacctttcttggcagtgaatgaatataatgctgagttggatttgatggaaaattattttaaaagtattcagctaaatatttgagcaaatctcagatacacagttaacagcccagatgtaagtgagtgaaagaaacaggtcagcaaaactttgcaccattga

SEQ ID NO: 302720 - DNA, 384 bp, Homo sapiens
gtctcaaactcccgacctcaggtgatccacctgccttggcctcccaaaatgctgggattacaggcatgagccaccacgtcccaccttggctaagtaatttataactatctcacctgtctttccccatctactaagtggagaaagtaagaatacctgctttgttaagattattggtagtttgagtaaaatagtatatggaaaccactatgtgtgggacatagtagttgatactcatagttttttagttattactgatcactgggactgtttggcatctagtgtctttttaggtatcatttttaccatctcttttcatattttattccaacaaaggctatggataggactagtgtagacgtggaatcactagacttggcactgtga

SEQ ID NO: 302721 - DNA, 2102 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcaggtaatttcaaagacacaaaatactcataaaaaacagaactgtgcttccagcttgcttaaccagattagcaaatgaataattcaccaaagtctgaaatagcaaaactgtatttcctgctaacagattactctaattcttctaggtctggttcaattttaaagcaaaatacaaatgccttagaaaattgtattttctgttatcttaaatacaatctatgataatggccaatagcaaacatttaattagcactgtttcctgcctttgttgtatgcctgatacatgtattaactcatttaatccttattgaaagtctgtgatgtataggtgctacatttttcaaaagaagaaactgaggtccagagaggttatatagctcactctggggtgagaacctaaagagtcaagactgtttttttaatcccgaaactttggtactgagcgaagtgctctttagtctcaatactgaataattgccttataatttggaagaaaatttaaataaagtttattgttgagtttcaataagtggccccaaacaaggggttaatattttatgtataatatgactcacctttttattgtaactaataaaactgcatttttatgatgctgcttttgttctttggaagacctaattttataaatgccattaataaaggagtaaaaagtcctggattttgttgcactaaattataattaatctcagcaataagaggtttaacatttaattggtgttagaaatcaggtaggtcaaatagaaacaagaaactctgtgtgtccagtctatacacatacaaatattcttgtgatattcaaccagttttcatttcataaatcatttctttcttgcactctctttagtaacttaatttcccacaatgtgcttaagtggcataatcataggaatttttggtcattattatattatgcaagaaatacatagaaatagatattttaaaaatcagagtctcataaaatacataaaggatgttatcacatatgacaaaggttgatattaagtatgcttaatacaaatctgaaacttgtaaaaaaaaatctctttgatggctaaaaaagttaccaatatttcttcagcctattctagaaggaagattgttttctaccttttgaattgtttttgacacataataattgtgcatatttatggagtacagtctggcattttaatgcacatgtactacgtgtaatgaaaaataaggataattagcatatctgtcacttttaatatttatcatttcttagtgttgagaacattccaaatcctcccttctagctatttgaaaatatacaataaattattgttaattatagtcagcctacatagctatagaacactagaatttattcctcctatctagctgtaattttgtattcattaac

SEQ ID NO: 302722 - DNA, 1390 bp, Homo sapiens
taaagaatgtgtattgaaattccagttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagtaaggaataagtatacccaataatacacatattttgaagttatttatttgacttcctagaatactggtatacctaaagatgatttcaaattatatcctttgtataaattttgaatactagtagggcaatcagaaacatttgaaatttgatattttaaaagtattttgattggaaaggagcttaaaggcagcagcacactattttattctgagtattacctgtggacaagaagattaattctgctaagagcatgctttcaaaactggaaaacccttcaggacaagtcacattttgtgacagtgagacgccaacaaccctgagaggtagtacagaaagaaaaagatggaggcagggtttgggaagttctggtgttgagaagtttattttcatttctcatggtttccagggagggacagcaagtggtagaatacctcattggtgagctctgagtgtttgagggactttatattctcgtgcatcacaaaatttataggcatgtgcagagaattttagaaccaggaacctcaggaattttgttgagactgtcgttgcaaaaaaaaaa

SEQ ID NO: 302723 - DNA, 436 bp, Homo sapiens
  misc_feature (434)..(434): n is a, c, g, or t
gtggggtgatctagaggatcccattcactcaacctgctgcttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattacttcatgttttttgaaagcactgcagccaggtgagtgaatgggaccggctcatagtcaccnca

SEQ ID NO: 302724 - DNA, 664 bp, Homo sapiens
  misc_feature (405)..(405): n is a, c, g, or t
tctgttccatctcatctcgggtggccgcccgatagcctcaagtcctcgttactgttcatcttcgaatctctgtcagcaacgcagagaggaccagagttattttctgtggctgaatggcctactctggaatccccagggttaaaacaactcacattcaacccttgagatgctaagttttcttgtaaagtaaaggaaatgttataagattttctgaaaccacgaacctttagcgatattgtcagaccttctccaacattttccactgcatttgtcagcaatcagagatgacctccacaccgaggcgaaccctccaccccccgacccgtctcctctctgcgtttgcagagaggacaaacccagagaggttctcgcgttgaccaaggaactgcttgctgatcctctctnaaacgcagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattaactcctctctgcgtttgggggat

SEQ ID NO: 302725 - DNA, 634 bp, Homo sapiens
aacagtagtgtacggctgagatgtggaagcctccgacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgagatgttggaaggcctttcaacatctcatgtctccttccaacatctcatggctgcatgatcatcttaccctcattttcaatgtacaagttgagcttctctctgtctatctgccatatatagctgattctcgattggcaggtccacagtactggtcttcacttttgcctttctgggcatgacgatgcaggaa

SEQ ID NO: 302726 - DNA, 481 bp, Homo sapiens
cctcttcccaaaaggctttagaatgtgttcaccatcatgagctgaccaacaatttctaaattcctactcagaaacacagcaaggggaatgcagtcaagcacaaagggcttaaatgaccagataaggctgggctggatgaataaagaggaatatcctatgaatgtgactgtgtagttttagagtatcccgattcaactgttatatttgacttgtggccttgtagacagtgtgttaatgtcagatcttctttttcagaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaaggtatgtattcattgttttaatcctgtttctataaagagtagaagtttatgcagataaaggcacattgacctccaca

SEQ ID NO: 302727 - DNA, 7234 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgtgattgtgcttggagtatttgtgttttattcttttacttcaacgggttcttgtctgttacatctctggtgatttgaaatatcaggaaagacagtttgtcagaaatgagaataatatagttgaaatcagttgggctaaaatattctacagcaagacaatttcttttgggtgaactgattctataatttacttacttttaatgtaaggattagatttattgttgagctgctttccagatcagactgtcactttatagtttttctatataaagattatatagttgcaaacaaaggttgtgaaatttcccttttgttgtttttgacttttaattaataaaagtacattgttttcatagca

SEQ ID NO: 302728 - DNA, 7428 bp, Homo sapiens
  misc_feature (7246)..(7246): n is a, c, g, or t
  misc_feature (7261)..(7261): n is a, c, g, or t
  misc_feature (7363)..(7363): n is a, c, g, or t
  misc_feature (7377)..(7377): n is a, c, g, or t
  misc_feature (7407)..(7407): n is a, c, g, or t
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgtgattgtgcttggagtatttgtgttttattcttttacttcaacgggttcttgtctgttacatctctggtgatttgaaatatcaggaaagacagtttgtcagaaatgagaataatatagttgaaatcagttgggctaaaatattctacagcaagacaatttcttttgggtgaactgattctataatttacttacttttaatgtaaggattagatttattgttgagctgctttccagatcagactgtcactttatagtttttctatataaagattatatagttgcaaacaaaggttgtgaaatttcccttttgttgtttttgacttttaattaataaaagtacattgttttcatagcaaacttagactgnccatgtaattttctncatattggttttccgatgccaagcccagttaataattaagttttttaacagctttctctcaagtgaaataaagtggattgtgaccatggtttatcagttatnggctaaaaaggttncactttaccatgtttaaactataatcatanggttttcatgcctaaaaggtc

SEQ ID NO: 302729 - DNA, 6156 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattttcaagtgctcaagaagtcgacgcggccgcgaatttagtagtagta

SEQ ID NO: 302730 - DNA, 2196 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302731 - DNA, 6838 bp, Homo sapiens
gctaggtgcgggctgggtggcggcaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302732 - DNA, 6825 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302733 - DNA, 6907 bp, Homo sapiens
  misc_feature (47)..(47): n is a, c, g, or t
  misc_feature (52)..(53): n is a, c, g, or t
  misc_feature (56)..(56): n is a, c, g, or t
tctttctctccttttttaagtggaggttttttggtttctatcacaanaaggnnggnggtctttcattggaagactgatttggaggatttttttgatctgcaaatcttgaagatggcttatagattttacctcttttttcatctgtttcatgttcttctttagctgcatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302734 - DNA, 2168 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302735 - DNA, 6651 bp, Homo sapiens
  misc_feature (32)..(32): n is a, c, g, or t
ggagaagtgccctgaagccgtgctcctcatcngatctctcagcctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302736 - DNA, 6754 bp, Homo sapiens
gtccaacttcatttttctgtatgtagatattcagttgtccaagcaccatttgttgaaaagattattcttccctattaaattatgttggcacttctaaaagaaggattccaaaagtagattaagaagcagttttaaaagaggattccaaagatgttacttactgttccagtaactcatgtcctccagaggtgatttttgaagagtgcgtatttttggcagttactttccatggcagttcagttacttcatgttcattaatttccctgactactggttgtcattttaattgtttaattgtagtaataatttaattgtttgttattttgaaggaaggggaagggaggttcaatgataagaaaagcattcttcctttttaatttaaataattagaacatacaatttgtactgaaatgatgtaaaaaggctcttattattgaatcattggttttgcttatccttttgtttgaagtataacttgtcatatcctttatagccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302737 - DNA, 2150 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302738 - DNA, 6419 bp, Homo sapiens
  misc_feature (47)..(47): n is a, c, g, or t
  misc_feature (52)..(53): n is a, c, g, or t
  misc_feature (56)..(56): n is a, c, g, or t
tctttctctccttttttaagtggaggttttttggtttctatcacaanaaggnnggnggtctttcattggaagactgatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302739 - DNA, 6800 bp, Homo sapiens
tacatatgaaattacacactattagtcacatattcttattcgtatgtgcaacatcagacttgtctagatccattctacaaggatgaatcaagtacacttgagtatcctggatctattctgacatcgagaaattctgaagggaaaggaaatacaacagtgtacacattaccacttgcatctatcatttaatgatgcttgagcttagaagcctattaaggtttatttttcaatttatgagataatgtgatagccggctatcacattatccaaaattgtgtttggagtctaataaaatatcacatgattttaggacccagcttcagataaagacttcctgtgagttcagtcaataaaatgactgtactaaaaaattactcacatatgtttatttttggtaaaatattggaaaataattgttacagaaaatgggaagggcatctcaccgtgtaccccattttgcaatattttggaaagagtagtactccattcacttaaggctttggcaacataatttcttcattgattgatagtgtacaggcatatcaatctcttgttttggagggaaaaaagatatataaaggcagaattatctatttcatgaattgtgaactagtttgaagtgtggtccaaagggatgttgcctcattaaaggtcagatttaataaaaaatgcatctggtgtgtgtaccagaaaaacacaggagttggatggattttttattaaatcaggccttaaacttgttaaatagttttgcatttttataaattatagtcatggttataacatttcagtagcaccataaaagtgcttggtttaggaattttttttttttaaactgagatagtgtgtaaatttctagatggctgtaataacatgcaggctctaagttactgattttatatatcaatatttgcagctttctaattagttgtgatttataatttaatgttttacttttggaaaataagtgacatttagaaaattaaatattactatgaggctgtattgtggtttcctaccctccctcacctttccatcccctcccacttccctactcccactgccccacaccctcttaatgcacaaggcattaacatatgctccaggttacttttttggtattaaattcggtgttagtcagcagaataatcattttctgcacaattatagtaacttaggtcaagtgtagttttatatagtggtaggtctgaatccattttctttaactgtgttgttgttgtaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302740 - DNA, 6039 bp, Homo sapiens
ataaaaccaacttaatttcaagttataagaattcgttggttctattatgaattaattacacttaaaatgacagggctggttttaaaggcttgggaacaaagtagcgaactgtatggtcagaggcaaacagttaattatttcacaaattaaaatctttatctgataattctcagtgtagtacctatttcagtgcattgatgtgcattctggcaggaatgttctgattctttgcatttggtgaacgtttattgttcactgaacacatccatttgcatttatgtaattgcttagtgtataatgacttcaaatgcagtgattgcctgcaaaacttgtgattagatatgtagtattttcaatgcatatgtatatttttgcttgttacttgttaacaatactcacatattctatgtttattatctgatgtgacttcatatacagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302741 - DNA, 6702 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302742 - DNA, 5067 bp, Homo sapiens
cccacccctgcaaaacaacagcaaaaacctttaccaggctctataacagggggaccaaacttgtttttgctcatcattgcctcacaaggtacctggcaccagtgagcacttggtaaatattagataaatgcacaactgactgcttctttagcaaactggatgatagaatatgttcttacattgtacctcagattgtgggtatccagttatgttggcttgtactggattacaaattaatcttacaagcaatgtgacttcagcaagcaaaggaaaatgttataatagtacacatttccataggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302743 - DNA, 1622 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaactatggcctcgttggcctcagcggtggagctctgccggccg

SEQ ID NO: 302744 - DNA, 6899 bp, Homo sapiens
  misc_feature (3435)..(3435): n is a, c, g, or t
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagattgagaaccctttttttttcgccccccaccggtttttttttttaaaaaaccccaaaacttccaaaagggagaccccctcccggggttttttttttttttttttaaccccctttttaacacaagaaccccttccccctggaaaaccccggcccctttttttaaaaatgtggaaaaacccccttcccgggggggtttttttcccaaaaagggattttttttgtgttaaaagggggttctccccccaaaaaattgttaaaaaaaggggttcccgcctgccagtanggtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302745 - DNA, 4650 bp, Homo sapiens
gatgaaggaacatgaaaggagagaatatttaaaaacattgaatgaagaagaagagaaaagaagaagagtctgaatttgaagaaatgaagaaaaagcatgaaaatcaccctaaagttaatcacccaggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302746 - DNA, 4367 bp, Homo sapiens
tgtttatggtcttagatattggagtagaggggggggggggtttagctggagacgactctcttaattttccaccgctacagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302747 - DNA, 1336 bp, Homo sapiens
gtggggtgatctagaggatcccattcactcaacctgctgcttcaggagagtgatttcactcaacctgctgcttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302748 - DNA, 3575 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaatagctgcagccgggccggacacacatcgccacgttaaatttatgtatctgcaaacattaga

SEQ ID NO: 302749 - DNA, 1292 bp, Homo sapiens
ggtcggtaccatccatcatcaggctgcttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302750 - DNA, 3953 bp, Homo sapiens
gatcgtttaaggataaacagttttgatcacatgagtactttatcaattgggatttttttgtttgtttccttagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302751 - DNA, 3402 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaatagatgcggcggtttcctttctgagggaacttctgaccctcctcctgcctctcggctcggtgttg

SEQ ID NO: 302752 - DNA, 1573 bp, Homo sapiens
  misc_feature (405)..(405): n is a, c, g, or t
tctgttccatctcatctcgggtggccgcccgatagcctcaagtcctcgttactgttcatcttcgaatctctgtcagcaacgcagagaggaccagagttattttctgtggctgaatggcctactctggaatccccagggttaaaacaactcacattcaacccttgagatgctaagttttcttgtaaagtaaaggaaatgttataagattttctgaaaccacgaacctttagcgatattgtcagaccttctccaacattttccactgcatttgtcagcaatcagagatgacctccacaccgaggcgaaccctccaccccccgacccgtctcctctctgcgtttgcagagaggacaaacccagagaggttctcgcgttgaccaaggaactgcttgctgatcctctctnaaacgcagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302753 - DNA, 3266 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagtaaggaataagtatacccaataatacacatattttgaagttatttatttgacttcctagaatactggtatacctaaagatgatttcaaattatatcctttgtataaattttgaatactagtagggcaatcagaaacatttgaaatttgatattttaaaagtattttgattggaaaggagcttaaaggcagcagcacactattttattctgagtattacctgtggacaagaagattaattctgctaagagcatgctttcaaaactggaaaacccttcaggacaagtcacattttgtgacagtgagacgccaacaaccctgagaggtagtacagaaagaaaaagatggaggcagggtttgggaagttctggtgttgagaagtttattttcatttctcatggtttccagggagggacagcaagtggtagaatacctcattggtgagctctgagtgtttgagggactttatattctcgtgcatcacaaaatttataggcatgtgcagagaattttagaaccaggaacctcaggaattttgttgagactgtcgttgcaaaaaaaaaa

SEQ ID NO: 302754 - DNA, 1461 bp, Homo sapiens
aggagttttgttcattaacttcctgatggcttctagaaatgtcatcaaagaaacatttcatatttatatccttttttgcttaaattttcttttgggtcaattcaaataatttattaatgtctatattaatataaaatagaaattgttaaatatttcaggaaaactttctgaaatataatttctccgtacaatgaaacagtttttttcatatatctataaatagatacaggagcctccagttatctaatgagggttacatatggtgcataattttaataccatatttgtttcatcttacttcaaatttgaaagtacttttgctataagtttcctaaaagtatttaatacttttttttttcaatttagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302755 - DNA, 1621 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302756 - DNA, 1717 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagcataaaatacacaagaggatttttatggaatggctccttgttacaaggaccacataaacccattttgaattattcaaccattgctgaacttcttgaaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302757 - DNA, 2579 bp, Homo sapiens
  misc_feature (2542)..(2542): n is a, c, g, or t
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgaggtgcctcccaacntccgcccacgctgacaataaagttgctctgagtttgg

SEQ ID NO: 302758 - DNA, 1857 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattttgtaagtctgttcttattaatcttgattatagatgctttctctaggttcattctgaaatgattcagtaaagtgtatatttcaaaatgacattttaaaatttatagattttaaatcaggattcccatttaatcctagctctgaaattctatttgatcctgacactctggggtcacaggtgactagtttctacctgaagagtctatgaatattcacatggcaagagggggactaaggagatgtactaaggagagattttagtctccccttaaatcaggcatctcctagatgctttgaggaagaagttgaaagtaggcatatgtggaaaaaatttagtgaaacaaggaaactttaccatgactcatagtaattaaattaaaccatctaatataggagtatgaagtacaataagagtgtacattcactcaagtgtgtagacctaactaccaaattacaggaaataattggatataccagtgattctgaaattgccttcacattagaaccacctagggactttaaaaactccaaggactagtccatacctcagttcaactaaatcagaaact

SEQ ID NO: 302759 - DNA, 1260 bp, Homo sapiens
atagtgttccaggtgattccagtatgcagccaaagatgagaattatggggatagagaaaaagtaacatttagagaaaatgactggaagattaattaaattcatacaggtatcaataaatgaatagaattatagaatttattattaaaatggaaagccaaaggcagaacttatataattatagagcttttgtatatttacttattacatttaatttttttaacagatttgttactgtgtttcactagatcccttagtatttctgcatctgataattgatctctgttttgttgttgaaaattcatttgtatacttttgtttttatctaggacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302760 - DNA, 1579 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaaggtaatttaaaaaatggacataaggccgcatctaatttgtaaatactaaagctgtggtagtatttcttttcaacaattttatagaaaatgtgtgtgtaattctgtttggcaacttttaaagaaataagtagatgtgttccctgccttagcccatggaaaccctatatttgaaatactaggtcatatttttatttgtggctaccattccttttttgaccacttgttaagttttttttcctttgtccagtgttgtatccagatttgcttaagtgtattaactaaatttactttgttctgagaaa

SEQ ID NO: 302761 - DNA, 1480 bp, Homo sapiens
  misc_feature (1478)..(1478): n is a, c, g, or t
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggaggtctgtgatcaattaccagggcactttgtaaaatagttcagcaagaatttctgccctgtcattgaacctttcatcgaacctaggcattatgattattacatttacatatattattttgcctttgtagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattacttcatgttttttgaaagcactgcagccaggtgagtgaatgggaccggctcatagtcaccnca

SEQ ID NO: 302762 - DNA, 1352 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302763 - DNA, 1042 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaatgctgtgccaagaattcggagattggccggtaccagggggaaatcatggggtaaactgtgagaagagccaaaacaaaatggggttggggcttataataaaaaagggaaaagtaaaattggaggagaagta

SEQ ID NO: 302764 - DNA, 1639 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattttgtaagtctgttcttattaatcttgattatagatgctttctctaggttcattctgaaatgattcagtaaagtgtatatttcaaaatgacattttaaaatttatagattttaaatcaggattcccatttaatcctagctctgaaattctatttgatcctgacactctggggtcacaggtgactagtttctacctgaagagtctatgaatattcacatggcaagagggggactaaggagatgtactaaggagagattttagtctccccttaaatcaggcatctcctagatgctttgaggaagaagttgaaagtaggcatatgtggaaaaaatttagtgaaacaaggaaactttaccatgactcatagtaattaaattaaaccatctaatataggagtatgaagtacaataagagtgtacattcactcaagtgtgtagacctaactaccaaattacaggaaataattggatataccagtgattctgaaattgccttcacattagaaccacctagggactttaaaaactccaaggactagtccatacctcagttcaactaaatcagaaact

SEQ ID NO: 302765 - DNA, 914 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctgtaagtcatacttaagtaattgaccatttatgttcagagatgacactgccagtgatacttccactgtaagcaagactttggctttttttcgtttttggtgggggcagggtggtagatgttaagttttgatgctttctaacccagtaatttacttagatgagagttaatgaattgggacacgtagatgatattctttttatgctttttgagcagtgaacatttgctatttatgctcataatatattgcaagtcaaaaattgactatattgcaagtcaaaaattgactatatttgact

SEQ ID NO: 302766 - DNA, 744 bp, Homo sapiens
  misc_feature (659)..(659): n is a, c, g, or t
cgactcgcccgtgctgctgccgccgccgaaggaggggcaaagctcaagatggcggacaaaacgccaggcggatctcagaaggccagttcaaagactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatngaatccagctctctggtgtccatggatgttcgactggcccatttacaatacatcaatgaaagaaggtgataatatgtcagtgggt

SEQ ID NO: 302767 - DNA, 1096 bp, Homo sapiens
aggagttttgttcattaacttcctgatggcttctagaaatgtcatcaaagaaacatttcatatttatatccttttttgcttaaattttcttttgggtcaattcaaataatttattaatgtctatattaatataaaatagaaattgttaaatatttcaggaaaactttctgaaatataatttctccgtacaatgaaacagtttttttcatatatctataaatagatacaggagcctccagttatctaatgagggttacatatggtgcataattttaataccatatttgtttcatcttacttcaaatttgaaagtacttttgctataagtttcctaaaagtatttaatacttttttttttcaatttagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattttgtaagtctgttcttattaatcttgattatagatgctttctctaggttcattctgaaatgattcagtaaagtgtatatttcaaaatgacattttaaaatttatagattttaaatcaggattcccatttaatcctagctctgaaattctatttgatcctgacactctggggtcacaggtgactagtttctacctgaagagtctatgaatattcacatggcaagagggggactaaggagatgtactaaggagagattttagtctccccttaaatcaggcatctcctagatgctttgaggaagaagttgaaagtaggcatatgtggaaaaaatttagtgaaacaaggaaactttaccatgactcatagtaattaaattaaaccatctaatataggagtatgaagtacaataagagtgtacattcactcaagtgtgtagacctaactaccaaattacaggaaataattggatataccagtgattctgaaattgccttcacattagaaccacctagggactttaaaaactccaaggactagtccatacctcagttcaactaaatcagaaact

SEQ ID NO: 302768 - DNA, 785 bp, Homo sapiens
aggagttttgttcattaacttcctgatggcttctagaaatgtcatcaaagaaacatttcatatttatatccttttttgcttaaattttcttttgggtcaattcaaataatttattaatgtctatattaatataaaatagaaattgttaaatatttcaggaaaactttctgaaatataatttctccgtacaatgaaacagtttttttcatatatctataaatagatacaggagcctccagttatctaatgagggttacatatggtgcataattttaataccatatttgtttcatcttacttcaaatttgaaagtacttttgctataagtttcctaaaagtatttaatacttttttttttcaatttagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcatttaggcatatgtggaaaaaatttagtgaaacaaggaaactttaccatgactcatagtaattaaattaaaccatctaatataggagtatgaagtacaataagagtgtacattcactcaagtgtgtagacctaactaccaaattacaggaaataattggatataccagtgattctgaaattgccttcacattagaaccacctagggactttaaaaactccaaggactagtccatacctcagttcaactaaatcagaaact

SEQ ID NO: 302769 - DNA, 886 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagcataaaatacacaagaggatttttatggaatggctccttgttacaaggtactttgcatttataatcagccacagtcacctcagtttcatcccgtatcttacaagtatgatgtgctgtatactcaaagcctcaccacctgcttgccccacccatttgcttaaatgtatcaattttttctaagcttaacttttaccaaaactggagttcaacagatgaatatttttccttcttagatgttaactaaacatttttaaaggtacaaaatttatgtacaaacataacccaaatgacatggaagttacttgatttgtgacttacctctgtaatgttcccctggcctacttgaaattcctacctttcctctagtctagtatcttattctcagttattcggaggaagttagggacctagaattcttgttttcagagcagtagaattttgctaacataattcaaaacatttatccctatcttggggcttgaagagaatgtgaaatgctttatcttctgt

SEQ ID NO: 302770 - DNA, 450 bp, Homo sapiens
ttatagatagatggcataaccctaaaaaggttgacaattccatttttggtgcagttacaaatcatttcacttgtttgtatttcaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcaggtaatttcaaagacacaaaatactcataaaaaacagaactgtgcttccagcttgcttaaccagattagcaaatgaataattcaccaaagtctgaaatagcaaaactgtatttcctgctaacagattactctaattcttctaggtctg

SEQ ID NO: 302771 - DNA, 388 bp, Homo sapiens
tgcctttgttgtatgcctgatacatgtattaactcatttaatccttattgaaagtctgtgatgtataggtgctacatttttcaaaagaagaaactgaggtccagagaggttatatagctcactctggggtgagaacctaaagagtcaagactgtttttttaatcccgaaactttggtactgagcgaagtgctctttagtctcaatactgaataattgccttataatttggaagaaaatttaaataaagtttattgttgagtttcaataagtggccccaaacaaggggttaatattttatgtataatatgactcacctttttattgtaactaataaaactgcatttttatgatgctgcttttgttctttggaagacctaattttataaa

SEQ ID NO: 302772 - DNA, 2222 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302773 - DNA, 2059 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcaggtaatttcaaagacacaaaatactcataaaaaacagaactgtgcttccagcttgcttaaccagattagcaaatgaataattcaccaaagtctgaaatagcaaaactgtatttcctgctaacagattactctaattcttctaggtctggttcaattttaaagcaaaatacaaatgccttagaaaattgtattttctgttatcttaaatacaatctatgataatggccaatagcaaacatttaattagcactgtttcctgcctttgttgtatgcctgatacatgtattaactcatttaatccttattgaaagtctgtgatgtataggtgctacatttttcaaaagaagaaactgaggtccagagaggttatatagctcactctggggtgagaacctaaagagtcaagactgtttttttaatcccgaaactttggtactgagcgaagtgctctttagtctcaatactgaataattgccttataatttggaagaaaatttaaataaagtttattgttgagtttcaataagtggccccaaacaaggggttaatattttatgtataatatgactcacctttttattgtaactaataaaactgcatttttatgatgctgcttttgttctttggaagacctaattttataaatgccattaataaaggagtaaaaagtcctggattttgttgcactaaattataattaatctcagcaataagaggtttaacatttaattggtgttagaaatcaggtaggtcaaatagaaacaagaaactctgtgtgtccagtctatacacatacaaatattcttgtgatattcaaccagttttcatttcataaatcatttctttcttgcactctctttagtaacttaatttcccacaatgtgcttaagtggcataatcataggaatttttggtcattattatattatgcaagaaatacatagaaatagatattttaaaaatcagagtctcataaaatacataaaggatgttatcacatatgacaaaggttgatattaagtatgcttaatacaaatctgaaacttgtaaaaaaaaatctctttgatggctaaaaaagttaccaatatttcttcagcctattctagaaggaagattgttttctaccttttgaattgtttttgacacataataattgtgcatatttatggagtacagtctggcattttaatgcacatgtactacgtgtaatgaaaaataaggataattagcatatctgtcacttttaatatttatcatttcttagtgttgagaacattccaaatcctcccttctagctatttgaaaatatacaataaattattgttaattatagtcagcctacatagctatagaacactagaatttattcctcctatctagctgtaattttgtattcattaac

SEQ ID NO: 302774 - DNA, 6879 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302775 - DNA, 6826 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302776 - DNA, 2179 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302777 - DNA, 1913 bp, Homo sapiens
cgactcgcccgtgctgctgccgccgccgaaggaggggcaaagctcaagatggcggacaaaacgccaggcggatctcagaaggccagttcaaagactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302778 - DNA, 6808 bp, Homo sapiens
cactactaatttataccttggaaacattaatccacagatgaatgaagaaatgctgtgccaagaatttggaagatttggaccgttagccagtgtgaaaatcatgtggcctagaactgatgaagagagagccagagagagaaattgcggctttgtggcctttatgaatagaagagattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302779 - DNA, 2004 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302780 - DNA, 6836 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccactgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302781 - DNA, 2053 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagaggaccacataaacccattttgaattattcaaccattgctgaacttcttgaaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302782 - DNA, 6165 bp, Homo sapiens
agcggccgctcgcgagcgagaatttaataaaaaatgcatctggtgtgtgtaccagaaaaacacaggagttggatggattttttattaaatcaggccttaaacttgttaaatagttttgcatttttataaattatagtcatggttataacatttcagtagcaccataaaagtgcttggtttaggaattttttttttttaaactgagatagtgtgtaaatttctagatggctgtaataacatgcaggctctaagttactgattttatatatcaatatttgcagctttctaattagttgtgatttataatttaatgttttacttttggaaaataagtgacatttagaaaattaaatattactatgaggctgtattgtggtttcctaccctccctcacctttccatcccctcccacttccctactcccactgccccacaccctcttaatgcacaaggcattaacatatgctccaggttacttttttggtattaaattcggtgttagtcagcagaataatcattttctgcacaattatagtaacttaggtcaagtgtagttttatatagtggtaggtctgaatccattttctttaactgtgttgttgttgtaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302783 - DNA, 6824 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggacccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302784 - DNA, 1940 bp, Homo sapiens
  misc_feature (1620)..(1620): n is a, c, g, or t
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggaaaaaaaaaaaaaaaaaaaaaaaaaaaaaaaaaaaaaaaaaaaaaaaaaaaaaaaaagggggggggggnaaaaattttccccggggggggccatttgggccccgccattttgttgtttaaaacagaggggcgcccccatatgaggaggacgattataattaatcaacaagagaagcagcggggcggccttatttaacaacgaagcgctaggatggaggagaaagaaacttccttcgccgtggtatactctttgaggaagagaacccctacttgctggcgggggggacacaacatgtgggcgagccacatctacttcagcagaaagtttaaaccagcctcccgagggaaaactatacaacatctgtgggcgttcatgatgtgtaccacac

SEQ ID NO: 302785 - DNA, 2114 bp, Homo sapiens
  misc_feature (1590)..(1590): n is a, c, g, or t
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacatttttaaaaaaaaaaaaaaaaaaaaaaaaaaaaaaaaaaaaaaaaaaaaaaaaaaaaaaaagggggggggggnaaaaaatcggggggggccccccaactattagcggaactacccccagtttttttgtgtcacaaagggggcggccccaatataggagaggagccggataataaaaaagagcaaggagacaggggcggcggcgttaaaacacacggtcgggtcacgggaaacaaacggctccgtcgggaactttggggaaagaaccacacactgcggcgcggcggggacacactagggggacaccaaccctacagaaaataacgagacagcggaacattaaccccggccgctatcgggtggaaaccccccggcagatattgtgcggggcagaaagttccgggacccaggtgtggtgcaagaatttaaccgagggcgaataactataccctagagacccacaactgcatatcgatacaccataaagcagaagtactccatacagactcccataggatacctgatcacaacaatttatgcaccccaaaccccccaacgcaccctctcgacactcactatctactcacacatacctaccg

SEQ ID NO: 302786 - DNA, 3567 bp, Homo sapiens
cgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaatgggatgcggcagccccccctccctttgtaacatcgttattaacactaaaata

SEQ ID NO: 302787 - DNA, 4890 bp, Homo sapiens
cccacccctgcaaaacaacagcaaaaacctttaccaggctctataacagggggaccaaacttgtttttgctcatcattgcctcacaaggtacctggcaccagtgagcacttggtaaatattagataaatgcacaactgactgcttctttagcaaactggatgatagaatatgttcttacattgtacctcagattgtgggtatccagttatgttggcttgtactggattacaaattaatcttacaagcaatgtgacttcagcaagcaaaggaaaatgttataatagtacacatttccataggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302788 - DNA, 2001 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtaaaaaaaatttt

SEQ ID NO: 302789 - DNA, 4147 bp, Homo sapiens
gcatctgcaacgactctcttaatcttcacggctacaactcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgt

SEQ ID NO: 302790 - DNA, 1353 bp, Homo sapiens
  misc_feature (1351)..(1351): n is a, c, g, or t
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattacttcatgttttttgaaagcactgcagccaggtgagtgaatgggaccggctcatagtcaccnca

SEQ ID NO: 302791 - DNA, 1341 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattacttcatgttttttgaaagcactggcagcgggttgagtggggtaccgagctc

SEQ ID NO: 302792 - DNA, 1316 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgaggtaagagatgtcataatgtttataagatttgctttcctaatataagaagaatgtaattttgcaggacattataaatgcattaaataagtgttgtgtgccaatgtctcaatagcaagatgattttctcatttatttaactttgggcagagtggtagttatcactctgattaaaggtcactgttggtcatg

SEQ ID NO: 302793 - DNA, 1053 bp, Homo sapiens
  misc_feature (968)..(968): n is a, c, g, or t
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatngaatccagctctctggtgtccatggatgttcgactggcccatttacaatacatcaatgaaagaaggtgataatatgtcagtgggt

SEQ ID NO: 302794 - DNA, 1227 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggaggtctgtgatcaattaccagggcactttgtaaaatagttcagcaagaatttctgccctgtcattgaacctttcatcgaacctaggcattatgattattacatttacatatattattttgcctttgtagatagaaatccaagctcctcctggtgtaccaataggttatgttattcagacttgggtgccaagtctgaataacataacctattggacaccaggaggagcttggatttctatcttctgaaggcagcaggttgagtga

SEQ ID NO: 302795 - DNA, 1083 bp, Homo sapiens
gcaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagaggaccacataaacccattttgaattattcaaccattgctgaacttcttgaaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggaggtctgtgatcaattaccagggcactttgtaaaatagttcagcaagaatttctgccctgtcattgaacctttcatcgaacctaggcattatgattattacatttacatatattattttgcctttgtagatagaaatccaagctcctcctggtgtaccaataggttatgttattcagacttggcacccatgtctaccaaagtttacaattcaaaatgagaaaagaggtggtcttaaatggccctcttttggtgacctgtgtggaaatgttattttgggggaatgtattt

SEQ ID NO: 302796 - DNA, 2413 bp, Homo sapiens
ccgcagggagcctggtacccgcctggagttcctttcccagtgctttcccataggcatctaagaatattccttcacagagttgccaagtgctaaaagttggtttcccaactcagaatgaaggaaccaggcttgtgcgtccgatgggcattgacattctggaaaacaagaataagaagctgtagcggcgcctgtaagtgggccggagcaggcgcagcttggccacctcccgccgaaaggcaaggaaggaccggctgcgacacgaggaagaaggcccctcggcctcagcagagcgctatcctccactggttacccgggttccccggcttgctaccgggctgctccgtgcatctttccccccaggcgtcaggaactgcgccctcatggcggaggtgaaggtgaaggtgcagccgcctgacgcggatccggtcgaaatagaaaacaggattatagaattatgtcaccagttccctcatggaatcacagaccaagtaattcagaatgaaatgcctcatatagaagcccagcagcgggcagtagccatcaataggttgttgtctatgggtcagttggatctcttaaggagcaatacgggccttttatatagaataaaggactctcagaatgctggtaaaatgaagggatccgataaccaagaaaaactagtatatcaaatcatagaggatgcaggaaataaaggaatatggagcagagatatccgctataaaagtaatttgccattaacagaaatcaacaaaattctgaagaatctggaaagtaaaaagcttatcaaagctgttaagtctgtagcagcctcaaaaaagaaggtgtatatgctctataacctgcagccagaccggtctgtgactggtggagcctggtacagtgaccaggattttgaatctgaatttgtagaggtgcttaaccaacagtgttttaaattcctacagtccaaggcagaaacagcacgagaaagcaaacagaacccaatgatacaaagaaatagttcatttgcctcatcacatgaagtgtggaaatatatctgcgaattgggaatcagtaaggtagagttatccatggaagacattgaaaccatcctgaatacactcatttatgatggaaaagtggagatgacgattattgctgcaaaagaaggcacagttggcagtgtagatggacacatgaaactgtacagggcagtcaatccaatcatccctcccacgggtttggtccgggcaccctgtggactctgcccggtttttgatgactgccacgaaggtggtgagatttcaccatctaactgtatttacatgacagagtggctcgaattttaatagagagctatgaactttattgacattttgcaaatgaagttacttagggagcagataatttaattcatgatggaacacgaaatctccttgaaagcaaacttcacaataatggacgtagacttgctgctatgaaaacatattttttttatttatgaagactaaatttatattggtaaaatagccagtagaatatgaaagaaataaggttagtagtgaaattcattcttcaataaataaaacactttgaaactccggaggaccacatctttcaagacttctgatgggtcaaggaaaaagatgccaacatacccgtatttaccaagtactatgataatggctagagtataaaaatgttctttttaaagttatttattaagttcttcattggaagtttttttttatatctggttcactaccaccattttctgtttcctactttctcagtggtttcattgaaaagaaattagaagtggttaaaggcaggaatagcaaagagtgcaaacttggggtatgactgggggagagtggaacatgccttttccgcacaatattaattcctttttgtatcagaaatgttcttttaggagattatgctaccatacttacttcaaacccaatgactactgtcaaggacatattttcagtacataaatactatcattttcattctaaagaatattttcactgttccttctttcttaaagtcttatgtttcactctttaactcaaatgtattctttgttagaatttaccctagattcttatttaatgtctgcagtagactgaatgtttgtgtgcaccgagaattctaatgttgaaatctcatttccaatgtgatggtatttggaggtggggcttttggtaagtgataggtcaggagagtaacagcgctcatgaatgggattagtgcccttatataaagagacccagagagctccatcaccccttctgccatgtgaaagggagaagacaaacatccacgaaccaggaagtgggtcctcaccagaaaacaaatctgtaagcaccttgatcttggacttcccagcctccagaattgtgagaaataaatttctgttgttgat

SEQ ID NO: 302797 - DNA, 2454 bp, Homo sapiens
ccgcagggagcctggtacccgcctggagttcctttcccagtgctttcccataggcatctaagaatattccttcacagagttgccaagtgctaaaagttggtttcccaactcagaatgaaggaaccaggcttgtgcgtccgatgggcattgacattctggaaaacaagaataagaagctgtagcggcgcctgtaagtgggccggagcaggcgcagcttggccacctcccgccgaaaggcaaggaaggaccggctgcgacacgaggaagaaggcccctcggcctcagcagagcgctatcctccactggttacccgggttccccggcttgctaccgggctgctccgtgcatctttccccccaggcgtcaggaactgcgccctcatggcggaggtgaaggtgaaggtgcagccgcctgacgcggatccggtcgaaatagaaaacaggattatagaattatgtcaccagttccctcatggaatcacagaccaagtaattcagaatgaaatgcctcatatagaagcccagcagcgggcagtagccatcaataggttgttgtctatgggtcagttggatctcttaaggagcaatacgggccttttatatagaataaaggactctcagaatgctggtaaaatgaagggatccgataaccaagaaaaactagtatatcaaatcatagaggatgcaggaaataaaggaatatggagcagagatatccgctataaaagtaatttgccattaacagaaatcaacaaaattctgaagaatctggaaagtaaaaagcttatcaaagctgttaagtctgtagcagcctcaaaaaagaaggtgtatatgctctataacctgcagccagaccggtctgtgactggtggagcctggtacagtgaccaggattttgaatctgaatttgtagaggtgcttaaccaacagtgttttaaattcctacagtccaaggcagaaacagcacgagaaagcaaacagaacccaatgatacaaagaaatagttcatttgcctcatcacatgaagtgtggaaatatatctgcgaattgggaatcagtaaggtagagttatccatggaagacattgaaaccatcctgaatacactcatttatgatggaaaagtggagatgacgattattgctgcaaaagaaggcacagttggcagtgtagatggacacatgaaactgtacagggcagtcaatccaatcatccctcccacgggtttggtccgggcaccctgtggactctgcccggtttttgatgactgccacgaaggtggtgagatttcaccatctaactgtatttacatgacagagtggctcgaattttaatagagagctatgaactttattgacattttgcaaatgaagttacttagggagcagataatttaattcatgatggaacacgaaatctccttgaaagcaaacttcacaataatggacgtagacttgctgctatgaaaacatattttttttatttatgaagactaaatttatattggtaaaatagccagtagaatatgaaagaaataaggttagtagtgaaattcattcttcaataaataaaacactttgaaactccggaggaccacatctttcaagacttctgatgggtcaaggaaaaagatgccaacatacccgtatttaccaagtactatgataatggctagagtataaaaatgttctttttaaagttatttattaagttcttcattggaagtttttttttatatctggttcactaccaccattttctgtttcctactttctcagtggtttcattgaaaagaaattagaagtggttaaaggcaggaatagcaaagagtgcaaacttggggtatgactgggggagagtggaacatgccttttccgcacaatattaattcctttttgtatcagaaatgttcttttaggagattatgctaccatacttacttcaaacccaatgactactgtcaaggacatattttcagtacataaatactatcattttcattctaaagaatattttcactgttccttctttcttaaagtcttatgtttcactctttaactcaaatgtattctttgttagaatttaccctagattcttatttaatgtctgcagtagactgaatgtttgtgtgcaccgagaattctaatgttgaaatctcatttccaatgtgatggtatttggaggtggggcttttggtaagtgataggtcaggagagtaacagcgctcatgaatgggattagtgcccttatataaagagacccagagagctccatcaccccttctgccatgtgaaagggagaagacaaacatccacgaaccaggaagtgggtcctcaccagaaaacaaatctgtaagcaccttgatcttggacttcccagcctccagaattgtgagaaataaatttctgttgttgatttttttttttttttttttttttttttttttttttttttttt

SEQ ID NO: 302798 - DNA, 1034 bp, Homo sapiens
  misc_feature (931)..(931): n is a, c, g, or t
ccgcagggagcctggtacccgcctggagttcctttcccagtgctttcccataggcatctaagaatattccttcacagagttgccaagtgctaaaagttggtttcccaactcagaatgaaggaaccaggcttgtgcgtccgatgggcattgacattctggaaaacaagaataagaagctgtagcggcgcctgtaagtgggccggagcaggcgcagcttggccacctcccgccgaaaggcaaggaaggaccggctgcgacacgaggaagaaggcccctcggcctcagcagagcgctatcctccactggttacccgggttccccggcttgctaccgggctgctccgtgcatctttccccccaggcgtcaggaactgcgccctcatggcggaggtgaaggtgaaggtgcagccgcctgacgcggatccggtcgaaatagaaaacaggattatagaattatgtcaccagttccctcatggaatcacagaccaagtaattcagaatgaaatgcctcatatagaagcccagcagcgggcagtagccatcaataggttgttgtctatgggtcagttggatctcttaaggagcaatacgggccttttatatagaataaaggactctcagaatgctggtaaaatgaagggatccgataaccaagaaaaactagtatatcaaatcatagaggatgcaggaaataaaggaatatggagcagagatatccgctataaaagtaatttgccattaacagaaatcaacaaaattctgaagaatctggaaagtaaaaagcttatcaaagctgttaagtctgtagcacctctaagactggtacagtgaccacgattttgaatctgcatttgtcgaggggttaaaccacagcgtttaaattctacagccaagcggaacagagagaagcaacgaccacgtcaagaaagcanggcctcctgaggggcattgccgggcccaggaggtccgggacagacccgaaccctgggaggggaattggcagcgggggacggccaccaggggcgctgcggcggc

SEQ ID NO: 302799 - DNA, 766 bp, Homo sapiens
ccgcagggagcctggtacccgcctggagttcctttcccagtgctttcccataggcatctaagaatattccttcacagagttgccaagtgctaaaagttggtttcccaactcagaatgaaggaaccaggcttgtgcgtccgatgggcattgacattctggaaaacaagaataagaagctgtagcggcgcctgtaagtgggccggagcaggcgcagcttggccacctcccgccgaaaggcaaggaaggaccggctgcgacacgaggaagaaggcccctcggcctcagcagagcgctatcctccactggttacccgggttccccggcttgctaccgggctgctccgtgcatctttccccccaggcgtcaggaactgcgccctcatggcggaggtgaaggtgaaggtgcagccgcctgacgcggatccggtcgaaatagaaaacaggattatagaattatgtcaccagttccctcatggaatcacagaccaagtaattcagaatgaaatgcctcatatagaagcccagcagcgggcagtagccatcaataggttgttgtctatgggtcagttggatctcttaaggagcaatacgggccttttatatagaataaaggactctcagaatgctgggtaagtacttgtttttttaattttaagaaaatgtttattattgcaaacgtatgtgttgggaataaagctaatacaaaattacataaacctgtcctgtgtatcatccctgcctcctatgatatattccatttcccagag

SEQ ID NO: 302800 - DNA, 1543 bp, Homo sapiens
tatacaagggttaatatgcgcacataaatctcgtgctgccaactgagaaggcctagaagtgatgacttcccaaagtgctgggattacaggcgtgagccactgcgcccagcaaccctttactgtttttaacaccctccaagtggatgtctccctatcctacttgtgtcctttctgatgtatcccttttttaggtagagttatccatggaagacattgaaaccatcctgaatacactcatttatgatggaaaagtggagatgacgattattgctgcaaaagaaggcacagttggcagtgtagatggacacatgaaactgtacagggcagtcaatccaatcatccctcccacgggtttggtccgggcaccctgtggactctgcccggtttttgatgactgccacgaaggtggtgagatttcaccatctaactgtatttacatgacagagtggctcgaattttaatagagagctatgaactttattgacattttgcaaatgaagttacttagggagcagataatttaattcatgatggaacacgaaatctccttgaaagcaaacttcacaataatggacgtagacttgctgctatgaaaacatattttttttatttatgaagactaaatttatattggtaaaatagccagtagaatatgaaagaaataaggttagtagtgaaattcattcttcaataaataaaacactttgaaactccggaggaccacatctttcaagacttctgatgggtcaaggaaaaagatgccaacatacccgtatttaccaagtactatgataatggctagagtataaaaatgttctttttaaagttatttattaagttcttcattggaagtttttttttatatctggttcactaccaccattttctgtttcctactttctcagtggtttcattgaaaagaaattagaagtggttaaaggcaggaatagcaaagagtgcaaacttggggtatgactgggggagagtggaacatgccttttccgcacaatattaattcctttttgtatcagaaatgttcttttaggagattatgctaccatacttacttcaaacccaatgactactgtcaaggacatattttcagtacataaatactatcattttcattctaaagaatattttcactgttccttctttcttaaagtcttatgtttcactctttaactcaaatgtattctttgttagaatttaccctagattcttatttaatgtctgcagtagactgaatgtttgtgtgcaccgagaattctaatgttgaaatctcatttccaatgtgatggtatttggaggtggggcttttggtaagtgataggtcaggagagtaacagcgctcatgaatgggattagtgcccttatataaagagacccagagagctccatcaccccttctgccatgtgaaagggagaagacaaacatccacgaaccaggaagtgggtcctcaccagaaaacaaatctgtaagcaccttgatcttggacttcccagcctccagaattgtgagaaataaatttctgttgttgat

SEQ ID NO: 302801 - DNA, 2103 bp, Homo sapiens
ccgcagggagcctggtacccgcctggagttcctttcccagtgctttcccataggcatctaagaatattccttcacagagttgccaagtgctaaaagttggtttcccaactcagaatgaaggaaccaggcttgtgcgtccgatgggcattgacattctggaaaacaagaataagaagctgtagcggcgcctgtaagtgggccggagcaggcgcagcttggccacctcccgccgaaaggcaaggaaggaccggctgcgacacgaggaagaaggcccctcggcctcagcagagcgctatcctccactggttacccgggttccccggcttgctaccgggctgctccgtgcatctttccccccaggcgtcaggaactgcgccctcatggcggaggtgaaggtgaaggtgcagccgcctgacgcggatccggtcgaaatagaaaacagggtcagttggatctcttaaggagcaatacgggccttttatatagaataaaggactctcagaatgctggtaaaatgaagggatccgataaccaagaaaaactagtatatcaaatcatagaggatgcaggaaataaaggaatatggagcagagatatccgctataaaagtaatttgccattaacagaaatcaacaaaattctgaagaatctggaaagtaaaaagcttatcaaagctgttaagtctgtagcagcctcaaaaaagaaggtgtatatgctctataacctgcagccagaccggtctgtgactggtggagcctggtacagtgaccaggattttgaatctgaatttgtagaggtgcttaaccaacagtgttttaaattcctacagtccaaggcagaaacagcacgagaaagcaaacagaacccaatgatacaaagaaatagttcatttgcctcatcacatgaagtgtggaaatatatctgcgaattgggaatcagtaaggtttttgatgactgccacgaaggtggtgagatttcaccatctaactgtatttacatgacagagtggctcgaattttaatagagagctatgaactttattgacattttgcaaatgaagttacttagggagcagataatttaattcatgatggaacacgaaatctccttgaaagcaaacttcacaataatggacgtagacttgctgctatgaaaacatattttttttatttatgaagactaaatttatattggtaaaatagccagtagaatatgaaagaaataaggttagtagtgaaattcattcttcaataaataaaacactttgaaactccggaggaccacatctttcaagacttctgatgggtcaaggaaaaagatgccaacatacccgtatttaccaagtactatgataatggctagagtataaaaatgttctttttaaagttatttattaagttcttcattggaagtttttttttatatctggttcactaccaccattttctgtttcctactttctcagtggtttcattgaaaagaaattagaagtggttaaaggcaggaatagcaaagagtgcaaacttggggtatgactgggggagagtggaacatgccttttccgcacaatattaattcctttttgtatcagaaatgttcttttaggagattatgctaccatacttacttcaaacccaatgactactgtcaaggacatattttcagtacataaatactatcattttcattctaaagaatattttcactgttccttctttcttaaagtcttatgtttcactctttaactcaaatgtattctttgttagaatttaccctagattcttatttaatgtctgcagtagactgaatgtttgtgtgcaccgagaattctaatgttgaaatctcatttccaatgtgatggtatttggaggtggggcttttggtaagtgataggtcaggagagtaacagcgctcatgaatgggattagtgcccttatataaagagacccagagagctccatcaccccttctgccatgtgaaagggagaagacaaacatccacgaaccaggaagtgggtcctcaccagaaaacaaatctgtaagcaccttgatcttggacttcccagcctccagaattgtgagaaataaatttctgttgttgat

SEQ ID NO: 302802 - DNA, 1778 bp, Homo sapiens
ccgcagggagcctggtacccgcctggagttcctttcccagtgctttcccataggcatctaagaatattccttcacagagttgccaagtgctaaaagttggtttcccaactcagaatgaaggaaccaggcttgtgcgtccgatgggcattgacattctggaaaacaagaataagaagctgtagcggcgcctgtaagtgggccggagcaggcgcagcttggccacctcccgccgaaaggcaaggaaggaccggctgcgacacgaggaagaaggcccctcggcctcagcagagcgctatcctccactggttacccgggttccccggcttgctaccgggctgctccgtgcatctttccccccaggcgtcaggaactgcgccctcatggcggaggtgaaggtgaaggtgcagccgcctgacgcggatccggtcgaaatagaaaacagggtcagttggatctcttaaggagcaatacgggccttttatatagaataaaggactctcagaatgctgggcagaaacagcacgagaaagcaaacagaacccaatgatacaaagaaatagttcatttgcctcatcacatgaagtgtggaaatatatctgcgaattgggaatcagtaaggtttttgatgactgccacgaaggtggtgagatttcaccatctaactgtatttacatgacagagtggctcgaattttaatagagagctatgaactttattgacattttgcaaatgaagttacttagggagcagataatttaattcatgatggaacacgaaatctccttgaaagcaaacttcacaataatggacgtagacttgctgctatgaaaacatattttttttatttatgaagactaaatttatattggtaaaatagccagtagaatatgaaagaaataaggttagtagtgaaattcattcttcaataaataaaacactttgaaactccggaggaccacatctttcaagacttctgatgggtcaaggaaaaagatgccaacatacccgtatttaccaagtactatgataatggctagagtataaaaatgttctttttaaagttatttattaagttcttcattggaagtttttttttatatctggttcactaccaccattttctgtttcctactttctcagtggtttcattgaaaagaaattagaagtggttaaaggcaggaatagcaaagagtgcaaacttggggtatgactgggggagagtggaacatgccttttccgcacaatattaattcctttttgtatcagaaatgttcttttaggagattatgctaccatacttacttcaaacccaatgactactgtcaaggacatattttcagtacataaatactatcattttcattctaaagaatattttcactgttccttctttcttaaagtcttatgtttcactctttaactcaaatgtattctttgttagaatttaccctagattcttatttaatgtctgcagtagactgaatgtttgtgtgcaccgagaattctaatgttgaaatctcatttccaatgtgatggtatttggaggtggggcttttggtaagtgataggtcaggagagtaacagcgctcatgaatgggattagtgcccttatataaagagacccagagagctccatcaccccttctgccatgtgaaagggagaagacaaacatccacgaaccaggaagtgggtcctcaccagaaaacaaatctgtaagcaccttgatcttggacttcccagcctccagaattgtgagaaataaatttctgttgttgat

SEQ ID NO: 302803 - DNA, 1226 bp, Homo sapiens
ccgcagggagcctggtacccgcctggagttcctttcccagtgctttcccataggcatctaagaatattccttcacagagttgccaagtgctaaaagttggtttcccaactcagaatgaaggaaccaggcttgtgcgtccgatgggcattgacattctggaaaacaagaataagaagctgtagcggcgcctgtaagtgggccggagcaggcgcagcttggccacctcccgccgaaaggcaaggaaggaccggctgcgacacgaggaagaaggcccctcggcctcagcagagcgctatcctccactggttacccgggttccccggcttgctaccgggctgctccgtgcatctttccccccaggcgtcaggaactgcgccctcatggcggaggtgaaggtgaaggtgcagccgcctgacgcggatccggtcgaaatagaaaacaggattatagaattatgtcaccagttccctcatggaatcacagaccaagtaattcagaatgaaatgcctcatatagaagcccagcagcgggcagtagccatcaataggttgttgtctatgggtcagttggatctcttaaggagcaatacgggccttttatatagaataaaggactctcagaatgctggtaaaatgaagggatccgataaccaagaaaaactagtatatcaaatcatagaggatgcaggaaataaaggaatatggagcagagatatccgctataaaagtaatttgccattaacagaaatcaacaaaattctgaagaatctggaaagtaaaaagcttatcaaagctgttaagtctgtagcagcctcaaaaaagaaggtgtatatgctctataacctgcagccagaccggtctgtgactggtggagcctggtacagtgaccaggattttgaatctgaatttgtagaggtgcttaaccaacagtgttttaaattcctacagtccaaggcagaaacagcacgagaaagcaaacagaacccaatgatacaaagaaatagttcatttgcctcatcacatgaagtgtggaaatatatctgcgaattgggaatcagtaaggtagagttatccatggaagacattgaaaccatcctgaatacactcatttatgatggaaaagtggagatgacgattattgctgcaaaagaaggcacagttggcagtgtagatggatagaatgtctgtggtgtatctcaaatttatggtccatatctcaagctatgg

SEQ ID NO: 302804 - DNA, 1204 bp, Homo sapiens
ccgcagggagcctggtacccgcctggagttcctttcccagtgctttcccataggcatctaagaatattccttcacagagttgccaagtgctaaaagttggtttcccaactcagaatgaaggaaccaggcttgtgcgtccgatgggcattgacattctggaaaacaagaataagaagctgtagcggcgcctgtaagtgggccggagcaggcgcagcttggccacctcccgccgaaaggcaaggaaggaccggctgcgacacgaggaagaaggcccctcggcctcagcagagcgctatcctccactggttacccgggttccccggcttgctaccgggctgctccgtgcatctttccccccaggcgtcaggaactgcgccctcatggcggaggtgaaggtgaaggtgcagccgcctgacgcggatccggtcgaaatagaaaacaggattatagaattatgtcaccagttccctcatggaatcacagaccaagtaattcagaatgaaatgcctcatatagaagcccagcagcgggcagtagccatcaataggttgttgtctatggtaaggtgaatctaactattttgcataattactgatatgctgattatcactggtttttattatgtagttgtgatggttaatttcatgtcaacttgactaagatacaggattcctacatatctagttaaatattttattggagtgtctgtgtgggtgtttctgaaagaggttagcattttgaattggtgaacggagtaaagtagatatgggtccagttgggtgagcatcatccaatccattcagggcctaaatagaacaaagtggcagaggaagattgaattcactctttgaattcaatcttgagctgggctatgaatcttgtgccctcagcactcctggttctcagaccttcagacttggactggtatctacaccatcagctctctgctctcagccctttgatctgcaacaccagctttcctgggtctccagcttgcagagggcagatgatgggactcctcagcctccataatcacagagcaaatagcttctgatgaatctttcaagagggaggtgtatcctattggttctttttctctggagaaccctaatacagcagtcataaaacgagaaagtgtgttaggtttgactgataagactctaaaccaggaaacagctcaaactacctgaattgaaaaaagaag

SEQ ID NO: 302805 - DNA, 481 bp, Homo sapiens
tcttttggtaaatatgtcactgtggtgaccttgtctgctaattttgtttaagtagtgatgtagattattagattatcctatagtccttaccttactaattttactttattccactacagttaaaatgaagggatccgataaccaagaaaaactagtatatcaaatcatagaggatgcaggaaataaaggtaagcatgtgaaagatgaagcagaaaaaaacattgtctttggaactagatatagggacccagatctcagcttcccagggtagaactcagtggacagagtatactgaggaaggtaatagaacatacaaatataacatgcatgtgcttgaaggacacccaagagtaaggccgttgttgccttgaaagagacaagaactaaagggctgtgtccagggatggaaaaagacgtctgaattctgagtcacatgaatgtattatctattcaaaataaataaaatttaagtttttttttt

SEQ ID NO: 302806 - DNA, 1047 bp, Homo sapiens
ccgcagggagcctggtacccgcctggagttcctttcccagtgctttcccataggcatctaagaatattccttcacagagttgccaagtgctaaaagttggtttcccaactcagaatgaaggaaccaggcttgtgcgtccgatgggcattgacattctggaaaacaagaataagaagctgtagcggcgcctgtaagtgggccggagcaggcgcagcttggccacctcccgccgaaaggcaaggaaggaccggctgcgacacgaggaagaaggcccctcggcctcagcagagcgctatcctccactggttacccgggttccccggcttgctaccgggctgctccgtgcatctttccccccaggcgtcaggaactgcgccctcatggcggaggtgaaggtgaaggtgcagccgcctgacgcggatccggtcgaaatagaaaacaggattatagaattatgtcaccagttccctcatggaatcacagaccaagtaattcagaatgaaatgcctcatatagaagcccagcagcgggcagtagccatcaataggttgttgtctatgggtcagttggatctcttaaggagcaatacgggccttttatatagaataaaggactctcagaatgctggtaaaatgaagggatccgataaccaagaaaaactagtatatcaaatcatagaggatgcaggaaataaaggaatatggagcagagatatccgctataaaagtaatttgccattaacagaaatcaacaaaattctgaagaatctggaaagtaaaaagcttatcaaagctgttaagtctgtagcagcctcaaaaaagaaggtgtatatgctctataacctgcagccagaccggtctgtgactggtggagcctggtacagtgaccaggattttgaatctgaatttgtagaggtgcttaaccaacagtgttttaaattcctacagtccaagagaacagccgagaagcgaacgagcccgatacggaccccacaccacggaagggcctggcccacggggtgacgggcacccggggcgcgccgggcag

SEQ ID NO: 302807 - DNA, 2353 bp, Homo sapiens
ccgcagggagcctggtacccgcctggagttcctttcccagtgctttcccataggcatctaagaatattccttcacagagttgccaagtgctaaaagttggtttcccaactcagaatgaaggaaccaggcttgtgcgtccgatgggcattgacattctggaaaacaagaataagaagctgtagcggcgcctgtaagtgggccggagcaggcgcagcttggccacctcccgccgaaaggcaaggaaggaccggctgcgacacgaggaagaaggcccctcggcctcagcagagcgctatcctccactggttacccgggttccccggcttgctaccgggctgctccgtgcatctttccccccaggcgtcaggaactgcgccctcatggcggaggtgaaggtgaaggtgcagccgcctgacgcggatccggtcgaaatagaaaacaggattatagaattatgtcaccagttccctcatggaatcacagaccaagtaattcagaatgaaatgcctcatatagaagcccagcagcgggcagtagccatcaataggttgttgtctatgggtcagttggatctcttaaggagcaatacgggccttttatatagaataaaggactctcagaatgctggtaaaatgaagggatccgataaccaagaaaaactagtatatcaaatcatagaggatgcaggaaataaaggaatatggagcagagatatccgctataaaagtaatttgccattaacagaaatcaacaaaattctgaagaatctggaaagtaaaaagcttatcaaagctgttaagtctgtagcaggagcctggtacagtgaccaggattttgaatctgaatttgtagaggtgcttaaccaacagtgttttaaattcctacagtccaaggcagaaacagcacgagaaagcaaacagaacccaatgatacaaagaaatagttcatttgcctcatcacatgaagtgtggaaatatatctgcgaattgggaatcagtaaggtagagttatccatggaagacattgaaaccatcctgaatacactcatttatgatggaaaagtggagatgacgattattgctgcaaaagaaggcacagttggcagtgtagatggacacatgaaactgtacagggcagtcaatccaatcatccctcccacgggtttggtccgggcaccctgtggactctgcccggtttttgatgactgccacgaaggtggtgagatttcaccatctaactgtatttacatgacagagtggctcgaattttaatagagagctatgaactttattgacattttgcaaatgaagttacttagggagcagataatttaattcatgatggaacacgaaatctccttgaaagcaaacttcacaataatggacgtagacttgctgctatgaaaacatattttttttatttatgaagactaaatttatattggtaaaatagccagtagaatatgaaagaaataaggttagtagtgaaattcattcttcaataaataaaacactttgaaactccggaggaccacatctttcaagacttctgatgggtcaaggaaaaagatgccaacatacccgtatttaccaagtactatgataatggctagagtataaaaatgttctttttaaagttatttattaagttcttcattggaagtttttttttatatctggttcactaccaccattttctgtttcctactttctcagtggtttcattgaaaagaaattagaagtggttaaaggcaggaatagcaaagagtgcaaacttggggtatgactgggggagagtggaacatgccttttccgcacaatattaattcctttttgtatcagaaatgttcttttaggagattatgctaccatacttacttcaaacccaatgactactgtcaaggacatattttcagtacataaatactatcattttcattctaaagaatattttcactgttccttctttcttaaagtcttatgtttcactctttaactcaaatgtattctttgttagaatttaccctagattcttatttaatgtctgcagtagactgaatgtttgtgtgcaccgagaattctaatgttgaaatctcatttccaatgtgatggtatttggaggtggggcttttggtaagtgataggtcaggagagtaacagcgctcatgaatgggattagtgcccttatataaagagacccagagagctccatcaccccttctgccatgtgaaagggagaagacaaacatccacgaaccaggaagtgggtcctcaccagaaaacaaatctgtaagcaccttgatcttggacttcccagcctccagaattgtgagaaataaatttctgttgttgat

SEQ ID NO: 302808 - DNA, 2505 bp, Homo sapiens
  misc_feature (1)..(1): n is a, c, g, or t
nattacggctaaggtacgagaccggcgttatcagaatccaggggcccggggctgtagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatataagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaa

SEQ ID NO: 302809 - DNA, 3020 bp, Homo sapiens
acggactgacctaccgaccattcttccgggtccagaaggtgatctccgcccgtgctcagaatccaggggcccggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagaagtctcgctctgtctccccggctggagtgcagtggcgtgatcttggctcactgcaacctctgtctcccgggttcaagaaattctcctgcctcagcctcccaagtagctgggactacaggcatgtgccaccacgcccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatataagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaa

SEQ ID NO: 302810 - DNA, 3380 bp, Homo sapiens
acggactgacctaccgaccattcttccgggtccagaaggtgatctccgcccgtgctcagaatccaggggcccggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagaagtctcgctctgtctccccggctggagtgcagtggcgtgatcttggctcactgcaacctctgtctcccgggttcaagaaattctcctgcctcagcctcccaagtagctgggactacaggcatgtgccaccacgcccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgaggtgtatcaagcttaattcctatatattagatataatataatgattttaaatgccagtttacaatgttataccaaatatgtgtattaatgttaacaaatctagattataaggggctgtgaggatgcaagttgtgctattttagcattagactatagaattttgggggtggggataagatttttaaatcatttcaattatacaagctctcaaattaaaattttacatgtttcttgaaacttataaaagtagtagtttcatacatgagttaagctaatttcctaatgcaggacaacacaaaggctttaatctagcagttattgatgtctatttcattaaataatacgtttttcccctataaagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatataagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaa

SEQ ID NO: 302811 - DNA, 2720 bp, Homo sapiens
acggactgacctaccgaccattcttccgggtccagaaggtgatctccgcccgtgctcagaatccaggggcccggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatataagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaa

SEQ ID NO: 302812 - DNA, 2075 bp, Homo sapiens
taagcaattctcctgcctcagcctcctgagtagctggggttacaggcattagccaccgcacccgctatagttacagatttctgaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatataagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaa

SEQ ID NO: 302813 - DNA, 2369 bp, Homo sapiens
acggactgacctaccgaccattcttccgggtccagaaggtgatctccgcccgtgctcagaatccaggggcccggggctgtagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaagtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatataagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaa

SEQ ID NO: 302814 - DNA, 3036 bp, Homo sapiens
acggactgacctaccgaccattcttccgggtccagaaggtgatctccgcccgtgctcagaatccaggggcccggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagaagtctcgctctgtctccccggctggagtgcagtggcgtgatcttggctcactgcaacctctgtctcccgggttcaagaaattctcctgcctcagcctcccaagtagctgggactacaggcatgtgccaccacgcccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatataagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggattcaggggggaccgaatgtgtgtgacgaaagcaattcagcagatcttggtccggcttcaatcttacatgttttccaaaaaaaggggggcaaataccggggcgctggcccttgtaaaggccagg

SEQ ID NO: 302815 - DNA, 2286 bp, Homo sapiens
acggactgacctaccgaccattcttccgggtccagaaggtgatctccgcccgtgctcagaatccaggggcccggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagaagtctcgctctgtctccccggctggagtgcagtggcgtgatcttggctcactgcaacctctgtctcccgggttcaagaaattctcctgcctcagcctcccaagtagctgggactacaggcatgtgccaccacgcccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgatatagagaaaggaagggaccaagagccttagaagccggaaagttggccctacggggggagagatatccggtagagaaagaacatctagcagaaaggg

SEQ ID NO: 302816 - DNA, 1854 bp, Homo sapiens
  misc_feature (1724)..(1724): n is a, c, g, or t
acggactgacctaccgaccattcttccgggtccagaaggtgatctccgcccgtgctcagaatccaggggcccggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagaagtctcgctctgtctccccggctggagtgcagtggcgtgatcttggctcactgcaacctctgtctcccgggttcaagaaattctcctgcctcagcctcccaagtagctgggactacaggcatgtgccaccacgcccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaaaaaaaaaaaaaaaaaaaanaaaaaacaccctttggggcccccctcacgccccagagaaaagtttttaaacccaatgcgtttgggcgcccgcggcgcccaagagggggaggcgacacagcggggccaaagccggggtcccaagggaaccc

SEQ ID NO: 302817 - DNA, 712 bp, Homo sapiens
gaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacagggtactgtgtggctgacttaatggatctactacataaagtcaaagttctggggccatttacatatagctcatttagtcttcacaacaatcccagagttattatacgtgtattacagataagcctcaaagataaattgttttcccacagacttataactaataggaagagtatagcaggattcaacttgggagttgtgaccataagtacagaccacaggtacaatctttcctctactatgccctttttttttcaactttttatcatagaaattttaaacagatacaaaagtaagaaaagaataatgaaattcgatctatccatcacataaattcattaggagttgcatagtggttatattctgttatttcctgttaatttattatgtggaattcttctctaaagagaaactttcccttctgctttaaataagttcttatctgatcaaatgtataaaattcagacttttggaaaatcacttaaccatcttctcccttatttcttcatttaaaagttataataataaatacccacacatgtaattatacattctag

SEQ ID NO: 302818 - DNA, 2530 bp, Homo sapiens
acggactgacctaccgaccattcttccgggtccagaaggtgatctccgcccgtgctcagaatccaggggcccggggctgtagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatataagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaa

SEQ ID NO: 302819 - DNA, 2368 bp, Homo sapiens
acggactgacctaccgaccattcttccgggtccagaaggtgatctccgcccgtgctcagaatccaggggcccggggctgtagagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatataagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaa

SEQ ID NO: 302820 - DNA, 2438 bp, Homo sapiens
atcctcaaagcttataagcgagtatcaagacatgtgatatggttttaaaatagctgatgataaagtatatacatcatctcattttctcctcttagtcttgtaataggaaggacagatattcaaacacttatttatttatttatttttaacagagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatataagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaa

SEQ ID NO: 302821 - DNA, 2101 bp, Homo sapiens
acggactgacctaccgaccattcttccgggtccagaaggtgatctccgcccgtgctcagaatccaggggcccggggctgtagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaaattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatataagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaa

SEQ ID NO: 302822 - DNA, 3169 bp, Homo sapiens
  misc_feature (3039)..(3039): n is a, c, g, or t
acggactgacctaccgaccattcttccgggtccagaaggtgatctccgcccgtgctcagaatccaggggcccggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagaagtctcgctctgtctccccggctggagtgcagtggcgtgatcttggctcactgcaacctctgtctcccgggttcaagaaattctcctgcctcagcctcccaagtagctgggactacaggcatgtgccaccacgcccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatataagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaaaaaaaaaaaaaaaaaaaanaaaaaacaccctttggggcccccctcacgccccagagaaaagtttttaaacccaatgcgtttgggcgcccgcggcgcccaagagggggaggcgacacagcggggccaaagccggggtcccaagggaaccc

SEQ ID NO: 302823 - DNA, 3046 bp, Homo sapiens
acggactgacctaccgaccattcttccgggtccagaaggtgatctccgcccgtgctcagaatccaggggcccggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagaagtctcgctctgtctccccggctggagtgcagtggcgtgatcttggctcactgcaacctctgtctcccgggttcaagaaattctcctgcctcagcctcccaagtagctgggactacaggcatgtgccaccacgcccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatataagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaacgtgttgtttgtttgaaggtagaaat

SEQ ID NO: 302824 - DNA, 2036 bp, Homo sapiens
acggactgacctaccgaccattcttccgggtccagaaggtgatctccgcccgtgctcagaatccaggggcccggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagaagtctcgctctgtctccccggctggagtgcagtggcgtgatcttggctcactgcaacctctgtctcccgggttcaagaaattctcctgcctcagcctcccaagtagctgggactacaggcatgtgccaccacgcccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcaatggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgtggagccttccttctgcaggagag

SEQ ID NO: 302825 - DNA, 2354 bp, Homo sapiens
gggaggaccccaatctaggcccaagagggaaaggccacgtgcctgtatgagcgtatgagcatgtgcatgcgcgtgtgtgcacagggtggtgcacctggcaggggtccttgagtgaggcatgccccattctgtagcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctcaaa

SEQ ID NO: 302826 - DNA, 2280 bp, Homo sapiens
caaagggtgagaggggcaggtggggctagggtggagaccaaagcactgatgtgacggaaccatcagccaggcaactggacctggtggatccaggaagactttctggaagaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtctacaataaaactcaggtcaccttcgaattaattaagctgacaaaatgaaaatgacttaattacccaaggtttggcatgtaaagatcttaagagggtgcagaacgaaccactcgaaaacgagtagcagtgtaatgaaggcttcttttttaaacaataacaaatgcttcatcaatctgagtgtggaaggtgatttatcaaaataaatattactaattg

SEQ ID NO: 302827 - DNA, 2394 bp, Homo sapiens
caaagggtgagaggggcaggtggggctagggtggagaccaaagcactgatgtgacggaaccatcagccaggcaactggacctggtggatccaggaagactttctggaagaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctcaaa

SEQ ID NO: 302828 - DNA, 2568 bp, Homo sapiens
caaagggtgagaggggcaggtggggctagggtggagaccaaagcactgatgtgacggaaccatcagccaggcaactggacctggtggatccaggaagactttctggaagaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctcaaaagaaaagaaagcagcgaacgacaccggcaccaagcacagcagccccgcaacccaacaacacaagcgcaaacaaggaacacaccgagggggggggcgccctccaaatcccccccgggggcgcgcgaaacgccccccccaccgttagcgggacacggggaccccacagcgcgctaa

SEQ ID NO: 302829 - DNA, 1685 bp, Homo sapiens
caaagggtgagaggggcaggtggggctagggtggagaccaaagcactgatgtgacggaaccatcagccaggcaactggacctggtggatccaggaagactttctggaagaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgtcggtgcttgatgtcaacacaggaagagcatgagattgggccatttcaggaaacaaccacacctctacaatggctgtgggttgcctgggtactgccttgctagagtaagttcgtaagtcaataacatggatgtcatgttactgtgcccctagacatcaaacttgtctgggagattctcgccaggctacaaacatagtcagagttacttat

SEQ ID NO: 302830 - DNA, 1186 bp, Homo sapiens
  misc_feature (1156)..(1156): n is a, c, g, or t
  misc_feature (1169)..(1169): n is a, c, g, or t
caaagggtgagaggggcaggtggggctagggtggagaccaaagcactgatgtgacggaaccatcagccaggcaactggacctggtggatccaggaagactttctggaagaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggtacggagctcccgggggccgggacgagggcctgggctcgggggagagggtcctgacaagacagcctccgagcaggcacggacagcgacgccaccatccggggctccctgagcggggtgcgggcgctgganccttaaccggccncaaccgcatcacccgtt

SEQ ID NO: 302831 - DNA, 781 bp, Homo sapiens
ctctgagtgttgcaatggcaatgtttctggcagggtgtgggggacccttgctcaatgacctcctgccctgttgctcagaggataccgctgccagaaaagggttggctcattgtggggcttcccaaggtactctggtagccccagcttctgacctggtcctttctctggtatggggataggaggagagctccggaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcaggtgagtccaaggggtcggaggcaggagctgcctggatcctgggagaaactgagggaagaagaagagatgcgaacttgcccttaggagcctccaggaggatgtggcagatacaaccccgctttcaagatcacatgggctgagggagtctgtacagccctcccatcagaaaccacagtctgcaggggagggtcaagaagctctactcccagtctgagaggggcaggatcctgtgacagatgcaagtgacaaagagaaacttcttgcccttttaggtgccacttccc

SEQ ID NO: 302832 - DNA, 2469 bp, Homo sapiens
caaagggtgagaggggcaggtggggctagggtggagaccaaagcactgatgtgacggaaccatcagccaggcaactggacctggtggatccaggaagactttctggaagaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggtacggagctcccgggggccgggacgagggcctgggctcgggggagagggtcctgacaagacagcctccgagcaggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctcaaa

SEQ ID NO: 302833 - DNA, 2373 bp, Homo sapiens
gcagcaccccagttctccccgcacgccggcactcgcggctgctggagccccggctggctcaccccggggccgggcagaattgggctccaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctcaaa

SEQ ID NO: 302834 - DNA, 883 bp, Homo sapiens
gttgtaacaggaaatacttcagcttgcaatactgatagtaatgtgtggcacccagatcacgctgtttttatctgcagttcctttttagtattgtacaaagtttcttgaagatttttaaatacataagtttaaaagagaattaactttcaatttgcaaattaaaatgagaatggttgccttttcttcattatcaagagatggtgagttgtcctcctgtaagtaaattggttcttttctttctaatattgtgttccttgaaaccttactctagtatgcagggagagtggagggtgcctaagtgtaaaataattaaaacttaagctgatataattatcaataatagtaaccagttctgatatctacttgataccataacggtgagcattgatagactttcatagatttttacataagattagcttgagcaagttttcctcttttgtaggtactggggggaaaattctggaaaaatttttagagagttctttctaaaatgtcgaaatgcaaagctgtataaattgctgttgacgttagctgtctgaccaggaagtactctctttaagcctcacttaaaaaactaagtgtctgtaataacttcctttctcgggatgaaggtgctgatagcctggggtgttcttataacttaagttcagttttttctttcctgtgaggaagaggcagttttttaaatgaagccatctctggggaaatcgtattgattgttgtagctaaatacggaatttttaaagtctttagtatgttgaactggaaatataggacatgcgtttgagatctactgtgagtaagtgtcattggtattttattttacatttaatgttgattataaatatggtttgtgtctaaacactgttaaaaaaaatga

SEQ ID NO: 302835 - DNA, 2936 bp, Homo sapiens
acggccattaccaatcgcgaaaccgttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttac

SEQ ID NO: 302836 - DNA, 711 bp, Homo sapiens
ggcaaatagtgagcattcaacaatatttgttgaatgaaagaatgagttgggtaagtggatggatccttaggttgatgacctgtgtatactagtgaactaactagactatgaagtaatgtatgttgtcacctatggctatgtctcaagaaaaaaatacctcttagcactatcagttttacttaattaattagtttcttttttttcttctcctagcatgagccaccgcgcccggccatatgtccattctttatttgggtttttttgtccttttgttattgagttgtgagaccaagaggcttttaatatttgtatgtatttgtattgccaccaagtaaaatgtgttagaaataatttaatggcaaaccttatttttctacaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgtaagtacttaaaagagtcttttagatagatcagattaagaaaggttggactctaggcctggcacagtgactcacgcctgtaatcctagcactttgcaaggccaaggtgggaggaaagaccagc

SEQ ID NO: 302837 - DNA, 3147 bp, Homo sapiens
aagcttgcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttac

SEQ ID NO: 302838 - DNA, 4191 bp, Homo sapiens
aagcttgcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatga

SEQ ID NO: 302839 - DNA, 3127 bp, Homo sapiens
gttgtaacaggaaatacttcagcttgcaatactgatagtaatgtgtggcacccagatcacgctgtttttatctgcagttcctttttagtattgtacaaagtttcttgaagatttttaaatacataagtttaaaagagaattaactttcaatttgcaaattaaaatgagaatggttgccttttcttcattatcaagagatggtgagttgtcctcctgttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttac

SEQ ID NO: 302840 - DNA, 3043 bp, Homo sapiens
aagcttgcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaaagcatgtcatggaacttcggcaacagccaaaaaacttaaaggccatggaaatgcaaaataaaaaaacagtttcaggacacttgcaaagtacagaccaaacagtataaagcactcaagaatcaccagttggaagttactccaaagaatgagct

SEQ ID NO: 302841 - DNA, 2357 bp, Homo sapiens
caggggtccggtgccactgggtggaagggggcgtggctgagggaactgccatatatgcagccttccttagttagagattaaactgggcacttttcacttatctgctttatgctactggtacccttgtgaggtaggcattgtcccccttctacaggccgaaacaccaaggcacgcatgtctgaccccacatcctaagtctttcttctgctctgctaggaaaccctcaacgttcccagccagaggaatgatgtgggttgctggggtggttgatgtgacacctgaaaggtactgtgagctgacagcagggctgccaaatggcacgaggaagccaaatgtacaatagatttgacttttcagctatttttaaaccgagagaaatcaccagcagggctgtttaaaaaaaaattaaaatgatgataggctgatattgccatgcataaatgttatcccaactgaaatattcattgctttagaaattctgaggaatatgaagtagttatttgcactttcttccagtagttccctgagaccaacgtaacagactattttcccagctcctgttctagaactaaattactaatgacccaggaggcatttggctctctgtgggaaagcagcacaatccaattgtgcttgagtgtcttttagcttctcatgagccatcccctaacacaggacactgacctagatccgcccagccgctgggcttgctagaacggcattgccagccccaggtggaccccaaacattgatattcttgtgagcaagttttaaatataatgatttagatgcattgatcacaggactcagccagccttcctcggtcctcccgtagttcctgtgtgtgtgtgtgtgtgtgtgtgtgtgcgcgcgcgcacttcatgtgtgtgtctatgtgtgtgtgcatgtcatatgtgtgcctatgggtgtatcgcgtgcacgtgggtgcctgttaggagatgctttccattaagaactgcatcgtgcttctttcagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcacaaaaa

SEQ ID NO: 302842 - DNA, 1302 bp, Homo sapiens
aagcttgcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggggaaaagggaaaggtgagaaaagagacacccaaattccagaacaatgtccagtgctaggtcaattccccctgtgaaggt

SEQ ID NO: 302843 - DNA, 1169 bp, Homo sapiens
aagcttgcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcataggtaagattagagaccagttatgtttcttttcagttgcaggactgtctattccaggaaccttgaaaattagtgcatgctccaatttttaggttgcctaagcattcatgggaagcaaatagattgctgcttctggatataaaggataaagttgccagaatttagcttctatctcttattctctcctacgtatccacaattatatcatctttgttcagtaggtaactgttctccaggctaaatgttgcagggaaatttgaaaaagggcccaccaatctttagatactgtgtcatgaagaaaagaaaa

SEQ ID NO: 302844 - DNA, 3127 bp, Homo sapiens
gttgtaacaggaaatacttcagcttgcaatactgatagtaatgtgtggcacccagatcacgctgtttttatctgcagttcctttttagtattgtacaaagtttcttgaagatttttaaatacataagtttaaaagagaattaactttcaatttgcaaattaaaatgagaatggttgccttttcttcattatcaagagatggtgagttgtcctcctgttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttac

SEQ ID NO: 302845 - DNA, 4324 bp, Homo sapiens
aagcttgcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcacaaaaa

SEQ ID NO: 302846 - DNA, 3714 bp, Homo sapiens
gttgtaacaggaaatacttcagcttgcaatactgatagtaatgtgtggcacccagatcacgctgtttttatctgcagttcctttttagtattgtacaaagtttcttgaagatttttaaatacataagtttaaaagagaattaactttcaatttgcaaattaaaatgagaatggttgccttttcttcattatcaagagatggtgagttgtcctcctgtaagtaaattggttcttttctttctaatattgtgttccttgaaaccttactctagtatgcagggagagtggagggtgcctaagtgtaaaataattaaaacttaagctgatataattatcaataatagtaaccagttctgatatctacttgataccataacggtgagcattgatagactttcatagatttttacataagattagcttgagcaagttttcctcttttgtaggtactggggggaaaattctggaaaaatttttagagagttctttctaaaatgtcgaaatgcaaagctgtataaattgctgttgacgttagctgtctgaccaggaagtactctctttaagcctcacttaaaaaactaagtgtctgtaataacttcctttctcgggatgaaggtgctgatagcctggggtgttcttataacttaagttcagttttttctttcctgtgaggaagaggcagttttttaaatgaagccatctctggggaaatcgtattgattgttgtagctaaatacggaatttttaaagtctttagtatgttgaactggaaatataggacatgcgtttgagatctactgtgagttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttac

SEQ ID NO: 302847 - DNA, 4338 bp, Homo sapiens
  misc_feature (35)..(35): n is a, c, g, or t
cagataggctaggtacgaggctggtgttaatcggncgagggtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcacaaaaa

SEQ ID NO: 302848 - DNA, 4327 bp, Homo sapiens
gtgacgcgttggtgcgtggacagtgtgtacagcaactgcgagtagcgtgacacttagaaggctgtctacatccctgtcatccgtgcactcagtgaccagacccgacggatcctgcggggtatcaagccacaggagagtgactcaggaactacgtgtgggagagtgaatgcggaggtgcgtggagtccggatgctcgtgggtggtggaccagccgtgtgcttgaggtatgcagtcgatcatagtacacaaggtgactggcatagttttaaatttgatgaggagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcacaaaaa

SEQ ID NO: 302849 - DNA, 3247 bp, Homo sapiens
gaatcttcccagcacaagatagagaggcagttcagcacaagcctacattggttctaggcagaacgatgatcctaccgaacagatctcaaataaaattaaattgagaaagcagatctttcaagggaatgaggcggaggctcgcttttatgttaaaagccaccagcatcctccttgctagacatggacatgacatttttaaaggaattatctggttacagcgttttaagcaaactgttctaaggagtctgtacattgcattattttttctattctttttttcttttgcatatatgtaattctggaggtaaagaaaaagcctgccagggattcagaaggcatcccactagcgatcagctgacattcctaactgaaggctgcaatgtgttgcttattcattttgtaccgtgggagctgcggggactagcagagagctaaactatgcatttcaaacagcagtgcttgtgcagaaagaggggtgagagagaggcagccggcgaggaaagagcacagctggactttctccttgtttttatccatttctgcaggatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcacaaaaa

SEQ ID NO: 302850 - DNA, 2610 bp, Homo sapiens
ttatgttctgacccaccatacacaaaaatcaatcagcatcttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcacaaaaa

SEQ ID NO: 302851 - DNA, 3176 bp, Homo sapiens
aagcttgcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaagtatttggagttcaacactgtctctcaatcagatcatcttgatctttttctttatctcccttccccttcctaagtcccatttcttggtcataaatattgcattattcacactttcaaactgtgtattttcttacaataaaaaatgatga

SEQ ID NO: 302852 - DNA, 3602 bp, Homo sapiens
aagcttgcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcggtaagtggttaggtttggtgccacggcttcgagagctttgggaatcaagaaaatccaagatccagcctgttgttcccaagatgattcttgcacaaatttaggatattgatgtttttctgcccaaaggactgaggaaaggacgacgttgaataaagccaagccaatgtggatacttgctggagtgtcttataagatggaactcaaggagtgacatgccacatcagacctgtggcacatagggactttgagggcaaatgtgatagataccacatatgataccatgtgttcatttatcaaagattttactgactgccctccccgcaactaatatcaggcacaaatgaataagagtccctgcccttagggagcccacagtcaagtgaggaagacagatacacagacacactcatgcaataaacttttattaagcatcagtgttcagcactctgctggactcagaggtggaggatgagctagacagacaatttgtcagtcaagccaggtggtcagataattaagcagtaatagtaaaacatggtaagtggggccgggcgcggtggctcacgcctgtaatcccagcattttgggaggccgaggcaggtggatcacaaggtcaggagttcgaaaccaggctgaccaacatggtgaaaccccatctctaccaaaagtacaaaaattagctgggcaggcacctgtagtcccagctactcaggaggctgaggcaggagaatcacttgaacccgggaggtggaggttgcagtgagctgagatcacatcactgcactccagcctgggtgacagagcaagactctgtctcaaaaa

SEQ ID NO: 302853 - DNA, 1589 bp, Homo sapiens
ctgtaggcaagggtgcatgaccgtgtgtgtcttctgtgtccgcagttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcacaaaaa

SEQ ID NO: 302854 - DNA, 3515 bp, Homo sapiens
  misc_feature (52)..(52): n is a, c, g, or t
  misc_feature (746)..(746): n is a, c, g, or t
gttctcggtggtctcctcctgcttggagttgctcagctgggtctctttctgnaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgnagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagtagatgggagcttccagcccctgcctcgcagacagatggtgaggatgaaagaatgcaggcatccctcgctatctgctgtccactctcgctgtcgtcatacctcaggagccaagtgcttttggatggtgagggtgcttgtcccgtctctgaagcacctgcccagggcctggcaccagccggcggacactgccttccccatgctgcccatgacccatgctgcccgtgacccatgcaggtggtctcctgggtgagtcctgcctcagacccggtagggtctacacactggaaagtttccccaaagcaagtcacacatgagcagcacccgggcggcttccaaagctccctgaaagctggcagaggggctttcctgtctgctttgcagttgacatattcatcatccactcctgcagtccacaaggcactggaacagtgacctctaaatagagccagactctccctttccttcactcttgcctaaggtggagcagatcccaaggctggggttaggcaagtcagggaaagaaccacagtcactgtttcttcatgaccgtctccaggccagggactgggctcacctgagctttgcagccgtgatagggcttattaatgcctctaatagccctgcctggtacgatgatccctattttacagatgaggaaactgcgcctcagagagttaagaggcgcccaagtgcacacagcggctggtaaggacagctgggacctgaccccagatccctctgaccctggttctcctgctgtctgcagggttggccgtgagtcccctccttgtaactgtcagcttttatgtgtgtgtgcattctcgtgtgtgtgtacattctcatgtgtgtgtgtgtgtgcacatgtgtaccatgtgcatgagggtttggctgtgtgtgacactatgtgtgtgtgtttgtgtgtgttgcctgcctgagctcagagagagccaaacccccagagaagggtgccccctccaccaaccaggtgagctccttgcagaggcctggccttcatcccacaaaccttgcagaccacaggctccctggcttgcagcccccaaaaatgaaggcagcgctctgctctggacgtggcctttccagcactcaccactctgaattaaacatcacaggcccccatctgcacatgtcgtggggctgcctcgggcagaggaccgtttccttttacgctgtgccatgccagggagatctgggcagcagcagagtcctgagatgtcctttgatgtacccacaggagagttcgctccttcccgaggcagtgtcccccagggcttggcaggccaggcccacagcagagacaccaaaccacagaatgggacggcagagggccctaaaaagcccattgtcatgcactggctgaaaatgaaagaaaacctgcagattt

SEQ ID NO: 302855 - DNA, 842 bp, Homo sapiens
aggcccctaaagggagttcaaccatcatgggccccaccatccctgagccattgggataccgaggtgtgaaccaccgggcatctgcagccccttccacttgctctgggaggcgctgcctcgagctaaaacagacgtgtcctccgagaagagcattgttcctcacaggccctgggttgagcagcctccacctctgctggaatctagaacagagacccccaagagactcagcaagatggggcactgtggctcccaaaagctgtgcccccttctcgttgagaaaatggatttttctcaattttcagatgctacctgtttggaatgctgtccctgggaaggcccagcgttccaaatggttagcatctaaaagtggagaaaaatccatttttctttgatgcaaaaggcaaagaggaatctaagctagattttgttcttattctttctgtattgaagagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctaccagaagctggagcagccaccttggggatcagcagacaccagcagcaggccaaaggatagtggagtggagggacaagaaggcctgggtgagccttctctgagaatcactgagctctgaaccatgaatgaactgcctacctctgtacttcctgttgtataggacaaagaaatccctatctattta

SEQ ID NO: 302856 - DNA, 3034 bp, Homo sapiens
  misc_feature (558)..(558): n is a, c, g, or t
  misc_feature (2788)..(2789): n is a, c, g, or t
  misc_feature (2791)..(2791): n is a, c, g, or t
ctcaaatatttaaagggctgtctcataaaagagaaataaaacatactcaatgagctccaggtgacagaactgagctcagagaccagaaatcacaaggagacagatctccgctgaatataaagacgagttctataataattggaaccttccagagaaggcatggactttgtgctttaaaagaatcgacagaataattagagaatagactttaccctgtccttgaaggtgggggataagggggctgggtaaatatgtattcctgaatgtctgttattttgctacttgtttttttgtctaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgnagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagtagatgggagcttccagcccctgcctcgcagacagatggtgaggatgaaagaatgcaggcatccctcgctatctgctgtccactctcgctgtcgtcatacctcaggagccaagtgcttttggatggtgagggtgcttgtcccgtctctgaagcacctgcccagggcctggcaccagccggcggacactgccttccccatgctgcccatgacccatgctgcccgtgacccatgcaggtggtctcctggatgaggaaactgcgcctcagagagttaagaggcgcccaagtgcacacagcggctgagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttaccctagtgtttcatttcctagaccagtattttgaacaatattatattttggagactgatgggagaagactggcatcttctcccatcagacctggcgcagcctgttagcagtccatgtggcagaggcgaggagtgccactccagctgcaccgtagctgcactctgtcttggtgtggggttctggcaggtctgggagcttaccgcactggttggcagcagagcagaattggaaacagggcacgtctttctgggatgtaagtcctgatgtttccccattaagnnanaaggccaggcatcccaacactttgggaggccgaggcaggcggattataagatcaggagtttgagaccagcctggcaaacatggtgaataccctgtctctactaaaaatacaaaaattagccaggtgtggtggcacatgcactgtagaatcccagctacacaggaggctgaggtgggagaatcacttgaacctgggaggcagaggttgcagtgagccaagaccacgccattgcacgccagccta

SEQ ID NO: 302857 - DNA, 2385 bp, Homo sapiens
  misc_feature (558)..(558): n is a, c, g, or t
ctcaaatatttaaagggctgtctcataaaagagaaataaaacatactcaatgagctccaggtgacagaactgagctcagagaccagaaatcacaaggagacagatctccgctgaatataaagacgagttctataataattggaaccttccagagaaggcatggactttgtgctttaaaagaatcgacagaataattagagaatagactttaccctgtccttgaaggtgggggataagggggctgggtaaatatgtattcctgaatgtctgttattttgctacttgtttttttgtctaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgnagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaaggaaagtgtagaggagcacgaactgagaaacgcaaaagaatcgacaccttgcaactgtgccttcaaagagaaagacaggcaggccctgccccacctgcctgcagtttgaacggatgacctaagagacaagcacgcgtccagccccgtctgtccattaagagtctgctctatgccaggtagagtgcagtggtgcaattcggtcactgaagctcaactccaggtcaggattctctgtcacagctccgagaactggactacggtggaccgaaaagctccctaaagatggccagaaggaagaatttaggaagagacccagaagccagcaaccttgtgtttcagcgggaaagtagagagcggcacgaggcagtggcctatggggcttggacctggttagatatgaacggggggccccgctggaaagcggagtgtacacacggaaagagggtgtcacaccgcatgggg

SEQ ID NO: 302858 - DNA, 1258 bp, Homo sapiens
  misc_feature (1012)..(1013): n is a, c, g, or t
  misc_feature (1015)..(1015): n is a, c, g, or t
aggcccctaaagggagttcaaccatcatgggccccaccatccctgagccattgggataccgaggtgtgaaccaccgggcatctgcagccccttccacttgctctgggaggcgctgcctcgagctaaaacagacgtgtcctccgagaagagcattgttcctcacaggccctgggttgagcagcctccacctctgctggaatctagaacagagacccccaagagactcagcaagatggggcactgtggctcccaaaagctgtgcccccttctcgttgagaaaatggatttttctcaattttcagatgctacctgtttggaatgctgtccctgggaaggcccagcgttccaaatggttagcatctaaaagtggagaaaaatccatttttctttgatgcaaaaggcaaagaggaatctaagctagattttgttcttattctttctgtattgaagagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttaccctagtgtttcatttcctagaccagtattttgaacaatattatattttggagactgatgggagaagactggcatcttctcccatcagacctggcgcagcctgttagcagtccatgtggcagaggcgaggagtgccactccagctgcaccgtagctgcactctgtcttggtgtggggttctggcaggtctgggagcttaccgcactggttggcagcagagcagaattggaaacagggcacgtctttctgggatgtaagtcctgatgtttccccattaagnnanaaggccaggcatcccaacactttgggaggccgaggcaggcggattataagatcaggagtttgagaccagcctggcaaacatggtgaataccctgtctctactaaaaatacaaaaattagccaggtgtggtggcacatgcactgtagaatcccagctacacaggaggctgaggtgggagaatcacttgaacctgggaggcagaggttgcagtgagccaagaccacgccattgcacgccagccta

SEQ ID NO: 302859 - DNA, 418 bp, Homo sapiens
  misc_feature (52)..(52): n is a, c, g, or t
gttctcggtggtctcctcctgcttggagttgctcagctgggtctctttctgnaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggaggttttggagagcagcatagcccatgaaaaaagaaaagcaa

SEQ ID NO: 302860 - DNA, 540 bp, Homo sapiens
ggttcttctttaaaaatacctatgaatgtacacgaactcaggtatatgaagaatagaagtgtgtaacccagatgtccaggcctggtagatataattatgtggtccacgttgggtcatgatgttcccaaatatcaaacctcctaagacttccaacagactcacacttgagaaaacctaagacttgtactggagcctcagggcagaattgtaaccttggagctctcagggccttgggatagtgaattcaagtctccgttatggcctggcaggatggctcatgcctgtaatctcagcactttgggaggccgaggcaggcggattataagatcaggagtttgagaccagcctggcaaacatggtgaataccctgtctctactaaaaatacaaaaattagccaggtgtggtggcacatgcactgtagaatcccagctacacaggaggctgaggtgggagaatcacttgaacctgggaggcagaggttgcagtgagccaagaccacgccattgcacgccagcctaacagagtgagactctgtcttt

SEQ ID NO: 302861 - DNA, 487 bp, Homo sapiens
cccagggtcagcaactgtaaaccaaaccccagggaaatagcaagcttcagattctgggtgacgatgacattcaaacaggcccctaaagggagttcaaccatcatgggccccaccatccctgagccattgggataccgaggtgtgaaccaccgggcatctgcagccccttccacttgctctgggaggcgctgcctcgagctaaaacagacgtgtcctccgagaagagcattgttcctcacaggccctgggttgagcagcctccacctctgctggaatctagaacagagacccccaagagactcagcaagatggggcactgtggctcccaaaagctgtgcccccttctcgttgagaaaatggatttttctcaattttcagatgctacctgtttggaatgctgtccctgggaaggcccagcgttccaaatggttagcatctaaaagtggagaaaaatccatttttctttgatgcaaaaggcaaagaggaa

SEQ ID NO: 302862 - DNA, 424 bp, Homo sapiens
cggccgcgggtaatgcctcttatgcgcgaacgttttccttgtagtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggtacctcggcacccccatgtccccacagaaaggcccgggcctcccttctcctggctaaactcaggctagcagcagacctctaggcctgggacaggaggacagagacccacgtgtggaatacctgcaatgtcagaaggggaccagggagggcactgacta

SEQ ID NO: 302863 - DNA, 425 bp, Homo sapiens
tacatgaaacaacttcttcctgagcctttcttttgagtctactttatttcttttacagatcataaagaccaccagaatgaatcatttctagatttaaagaacctcagaatggaaaacaatgtccagaaaatactactggatgcaaaaccggatttgccaactctctcaagaatagagatcctagcggtaaccaaagaaaattctctctgctgtgactggcatgtggagaggaggggcctgagggcagacactagcttcgttccctggcacagccatacatgtcagtggtttggggctggctgctgtctatactcactagctggggccccgaccatacccgttgtccagggtttgcacagaaaggtagccttccacttgcccacagtatggttccgcatggtgttgacattgggccacgttaatcg

SEQ ID NO: 302864 - DNA, 3048 bp, Homo sapiens
tagcgggggtcagctccgcccaccctccccggctccgcccgcctcccgggtcagcggcgcgggtgctgcgcctagctgcgcaccatggccgggttgctggcgttgctgggtccggcaggcagggtgggcgcccgggtccggcctcgcgccacctggctcctgggcgccaccgccccctgcgccccgccgcccctggccctggccctgctcccgcccaggctagacgcccggctgctccgcacggcgcgcggggactgccgcggccaccaggaccccagccaggccacggggacaacaggcagcagcgtcagctgcacagaggagaaaaagcaaagcaagtcacagcaactgaaaaagatttttcaagagtatggcactgttggcgtgtcattgcacattggaatctcattaatttccttgggcatattttacatggttgtgtcaagtggtgtggacatgcctgcaatcctgctgaaactcggatttaaagagtccctggtacagtcaaaaatggcagcaggcacaagtaccttcgtggtggcctatgcaatccacaagctgtttgcgccagtgagaatcagcattacgctagtctctgtgcccttgattgtcagatattttcgaaaagtgggattttttaaacctccagctgcaaaaccttaatgaactcttcagtcgtacacactgaaaacctatttcttctaaattacatgatttggattggttttagggttttagggttgtagggtttcttttggagaggtagggggctaattgctatgttctcatggataaactttgccagcaaaaatcaggcttttgaacaattttaattttttgcctcataaattttgtgaatgctattcattatagggcttgtatatataatctaaaatgtcagcaaggcatcggagatgggttaacatctcaaaacaaaatagcctacaaatgttccttgtgggagactttggcgagggtctgtgggtaaaagcaccagggggttaatcttggctcagtttcctaaaaagcattgattaatttaactggcttttaaatatccccttccgctgatatttgttgtcagctgcctacagtttaatatgcagcgttcacaaaacagctgccagtgctacaattaatgaagcaaaacttaatatgtaatcacaatctaaattagcatcaatactttgacattcattacattggtttgggggaagaaaagtagttctggtatgtttcattgatccccagataccttccaatctggacatgatggggctgattccagatggtttttctgaaatttcattaaggtaggtcagcgtcatttgtctctgtttaggtaaaatataaaaaccctgcccagtagcagtggcatcgcttggttcctgatgcccatgttccagaggaattcggataccacaaacagctaagacaatctcagcttttcttagacaatcttctatctcaaacttcagacattccagaattgtcatgatgtttacactgtctgagttaaaaatcctgttcaagaaaaaaaaagattttgtatcacttcttaaaaaggaatattcatagcacttgtcacaaatagaaggcaaccatgagataatacaagccagggagaggcttgtattacatgacaggtgtaattagtctgctgagccagctttacccaatgaagggcatatgtgttagagagattagctaagagtagaaattcgagcatagaggccaggtgcggtggctcacgcctgtaatcccagcactttgggaggttgaggcaggcgtgtcacttgaggccaggagttcgagaccagcctggccaacatgatgaaaccccgtctctactacaaatacaaaaattagccgggtgtggtggcacacgcctgtagtcccagctactggggaggctgaggcagcattgcttgaacccaggaggtggaggttgcagtgagccaagatcacaccactgcactccagcctgggcgacagagggagacactgtctccaaaagaaagaaatcccagcgtagatccaaactgagacactgaggcttcgtccttatagtagtcaggagcaggcgattgaagtaattctgtcctgcggggttcagcatcatgcacgttccccctgggccattctctgatgcagggcacttgctccacactctgggaacccagattcaccagtctgccctgtcacgtagttgaaggagttgcatttatctttctggctcctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcaaggtctttcaggtagaactcttcttttaaggcaattagcccattgccaaaaggttttactgtcttaaagctgtctttctgagatctaattccaaggacttctccacagctaagtgagatgcctcacaccattaggtgatgctttggacagaacagagtattttcatcttgtgtttaaagcaattccttggcttcggctcctcaccactttctatgccagtctcccatttatgtccctagtaatgcctatgcaaaaaaaaaaaaagaaaaaaaagaaaaactgatggtgaaacctacaggtttaagggcttaaatctcaaactttgttaggagtaacaggagcgtgctgagcgggcaagcaataaaacaaatcataccaaaaagccacattgctctctcctaagccccaaccccactccactcctgtggccaggggtccaaacagaaaataaccggagaagacaaggaggtcaaaggatcagggaactaagcattatgtgaattcaccagcaagatgtacagaacgcctgtgtttacattgtttttatggaactagcagaataaaacatctattttaaaaatgaaaaaaaaagtt

SEQ ID NO: 302865 - DNA, 812 bp, Homo sapiens
tagcgggggtcagctccgcccaccctccccggctccgcccgcctcccgggtcagcggcgcgggtgctgcgcctagctgcgcaccatggccgggttgctggcgttgctgggtccggcaggcagggtgggcgcccgggtccggcctcgcgccacctggctcctgggcgccaccgccccctgcgccccgccgcccctggccctggccctgctcccgcccaggctagacgcccggctgctccgcacggcgcgcggggactgccgcggccaccagtccgacaggtggcacacaggtcttggggatcctctccagagtggcaccttctgcacacaccgtgccgcctcctgatgattcttcagggcccagcccagctgttccttcctccgggaagccctctctaacgacctgtgaggtctcggatgcctccactgggcctgcttccaccccatggctgtgggtcttctctgcactcatctggaatggcctcttgtcctgcctgtcagccacattgaccttgtccccagctcaggccctggcactggagcggtgtgtgtgtatacagtggcaaagagttggcctcagactccctggattcctctctctactcacttgttgttgactttgatcaaattcccttctctctatctcaggcccctcatctgtaaaatgggacgttaataattcagacttcatagaatatgaatgtaaaatgagatatgttcatacctggcatctggtgtgtcctaaattaaggttagaaatgactataattgcagtaaatatatacagtcacaaggccccagggccccgtgagc

SEQ ID NO: 302866 - DNA, 3082 bp, Homo sapiens
tagcgggggtcagctccgcccaccctccccggctccgcccgcctcccgggtcagcggcgcgggtgctgcgcctagctgcgcaccatggccgggttgctggcgttgctgggtccggcaggcagggtgggcgcccgggtccggcctcgcgccacctggctcctgggcgccaccgccccctgcgccccgccgcccctggccctggccctgctcccgcccaggctagacgcccggctgctccgcacggcgcgcggggactgccgcggccaccaggaccccagccaggccacggggacaacaggcagcagcgtcagctgcacagaggagaaaaagcaaagcaagtcacagcaactgaaaaagatttttcaagagtatggcactgttggcgtgtcattgcacattggaatctcattaatttccttgggcatattttacatggttgtgtcaagtggtgtggacatgcctgcaatcctgctgaaactcggatttaaagagtccctggtacagtcaaaaatggcagcaggcacaagtaccttcgtggtggcctatgcaatccacaagctgtttgcgccagtgagaatcagcattacgctagtctctgtgcccttgattgtcagatattttcgaaaagtgggattttttaaacctccagctgcaaaaccttaatgaactcttcagtcgtacacactgaaaacctatttcttctaaattacatgatttggattggttttagggttttagggttgtagggtttcttttggagaggtagggggctaattgctatgttctcatggataaactttgccagcaaaaatcaggcttttgaacaattttaattttttgcctcataaattttgtgaatgctattcattatagggcttgtatatataatctaaaatgtcagcaaggcatcggagatgggttaacatctcaaaacaaaatagcctacaaatgttccttgtgggagactttggcgagggtctgtgggtaaaagcaccagggggttaatcttggctcagtttcctaaaaagcattgattaatttaactggcttttaaatatccccttccgctgatatttgttgtcagctgcctacagtttaatatgcagcgttcacaaaacagctgccagtgctacaattaatgaagcaaaacttaatatgtaatcacaatctaaattagcatcaatactttgacattcattacattggtttgggggaagaaaagtagttctggtatgtttcattgatccccagataccttccaatctggacatgatggggctgattccagatggtttttctgaaatttcattaaggtaggtcagcgtcatttgtctctgtttaggtaaaatataaaaaccctgcccagtagcagtggcatcgcttggttcctgatgcccatgttccagaggaattcggataccacaaacagctaagacaatctcagcttttcttagacaatcttctatctcaaacttcagacattccagaattgtcatgatgtttacactgtctgagttaaaaatcctgttcaagaaaaaaaaagattttgtatcacttcttaaaaaggaatattcatagcacttgtcacaaatagaaggcaaccatgagataatacaagccagggagaggcttgtattacatgacaggtgtaattagtctgctgagccagctttacccaatgaagggcatatgtgttagagagattagctaagagtagaaattcgagcatagaggccaggtgcggtggctcacgcctgtaatcccagcactttgggaggttgaggcaggcgtgtcacttgaggccaggagttcgagaccagcctggccaacatgatgaaaccccgtctctactacaaatacaaaaattagccgggtgtggtggcacacgcctgtagtcccagctactggggaggctgaggcagcattgcttgaacccaggaggtggaggttgcagtgagccaagatcacaccactgcactccagcctgggcgacagagggagacactgtctccaaaagaaagaaatcccagcgtagatccaaactgagacactgaggcttcgtccttatagtagtcaggagcaggcgattgaagtaattctgtcctgcggggttcagcatcatgcacgttccccctgggccattctctgatgcagggcacttgctccacactctgggaacccagattcaccagtctgccctgtcacgtagttgaaggagttgcatttatctttctggctcctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcaaggtctttcaggtagaactcttcttttaaggcaattagcccattgccaaaaggttttactgtcttaaagctgtctttctgagatctaattccaaggacttctccacagctaagtgagatgcctcacaccattaggtgatgctttggacagaacagagtattttcatcttgtgtttaaagcaattccttggcttcggctcctcaccactttctatgccagtctcccatttatgtccctagtaatgcctatgcaaaaaaaaaaaaagaaaaaaaagaaaaactgatggtgaaacctacagatttaagcccttaaacctgtaggtttcaccatcagtttaagggcttaaatctcaaactttgttaggagtaacaggagcgtgctgagcgggcaagcaataaaacaaatcataccaaaaagccacattgctctctcctaagccccaaccccactccactcctgtggccaggggtccaaacagaaaataaccggagaagacaaggaggtcaaaggatcagggaactaagcattatgtgaattcaccagcaagatgtacagaacgcctgtgtttacattgtttttatggaactagcagaataaaacatctattttaaaaatgaaaaaaaaagtt

SEQ ID NO: 302867 - DNA, 3233 bp, Homo sapiens
tagcgggggtcagctccgcccaccctccccggctccgcccgcctcccgggtcagcggcgcgggtgctgcgcctagctgcgcaccatggccgggttgctggcgttgctgggtccggcaggcagggtgggcgcccgggtccggcctcgcgccacctggctcctgggcgccaccgccccctgcgccccgccgcccctggccctggccctgctcccgcccaggctagacgcccggctgctccgcacggcgcgcggggactgccgcggccaccaggaccccagccaggccacggggacaacaggcagcagcgtcagctgcacagaggagaaaaagcaaagcaagtcacagcaactgaaaaagatttttcaagagtatggcactgttggcgtgtcattgcacattggaatctcattaatttccttgggcatattttacatggttgtgtcaagtggtgtggacatgcctgcaatcctgctgaaactcggatttaaagagtccctggtacagtcaaaaatggcagcaggcacaagtaccttcgtggtggcctatgcaatccacaagctgtttgcgccagtgagaatcagcattacgctagtctctgtgcccttgattgtcagatattttcgaaaagtgggattttttaaacctccagctgcaaaaccttaatgaactcttcagtcgtacacactgaaaacctatttcttctaaattacatgatttggattggttttagggttttagggttgtagggtttcttttggagaggtagggggctaattgctatgttctcatggataaactttgccagcaaaaatcaggcttttgaacaattttaattttttgcctcataaattttgtgaatgctattcattatagggcttgtatatataatctaaaatgtcagcaaggcatcggagatgggttaacatctcaaaacaaaatagcctacaaatgttccttgtgggagactttggcgagggtctgtgggtaaaagcaccagggggttaatcttggctcagtttcctaaaaagcattgattaatttaactggcttttaaatatccccttccgctgatatttgttgtcagctgcctacagtttaatatgcagcgttcacaaaacagctgccagtgctacaattaatgaagcaaaacttaatatgtaatcacaatctaaattagcatcaatactttgacattcattacattggtttgggggaagaaaagtagttctggtatgtttcattgatccccagataccttccaatctggacatgatggggctgattccagatggtttttctgaaatttcattaaggtaggtcagcgtcatttgtctctgtttaggtaaaatataaaaaccctgcccagtagcagtggcatcgcttggttcctgatgcccatgttccagaggaattcggataccacaaacagctaagacaatctcagcttttcttagacaatcttctatctcaaacttcagacattccagaattgtcatgatgtttacactgtctgagttaaaaatcctgttcaagaaaaaaaaagattttgtatcacttcttaaaaaggaatattcatagcacttgtcacaaatagaaggcaaccatgagataatacaagccagggagaggcttgtattacatgacaggtgtaattagtctgctgagccagctttacccaatgaagggcatatgtgttagagagattagctaagagtagaaattcgagcatagaggccaggtgcggtggctcacgcctgtaatcccagcactttgggaggttgaggcaggcgtgtcacttgaggccaggagttcgagaccagcctggccaacatgatgaaaccccgtctctactacaaatacaaaaattagccgggtgtggtggcacacgcctgtagtcccagctactggggaggctgaggcagcattgcttgaacccaggaggtggaggttgcagtgagccaagatcacaccactgcactccagcctgggcgacagagggagacactgtctccaaaagaaagaaatcccagcgtagatccaaactgagacactgaggcttcgtccttatagtagtcaggagcaggcgattgaagtaattctgtcctgcggggttcagcatcatgcacgttccccctgggccattctctgatgcagggcacttgctccacactctgggaacccagattcaccagtctgccctgtcacgtagttgaaggagttgcatttatctttctggctcctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcaaggtctttcaggtagaactcttcttttaaggcaattagcccattgccaaaaggttttactgtcttaaagctgtctttctgagatctaattccaaggacttctccacagctaagtgagatgcctcacaccattaggtgatgctttggacagaacagagtattttcatcttgtgtttaaagcaattccttggcttcggctcctcaccactttctatgccagtctcccatttatgtccctagtaatgcctatgcaaaaaaaaaaaaagaaaaaaaagaaaaacaaaaaaacaaaaaaaaaaaaacaaaaaacaaaaggagggggcggcgcgcccctaaaagattctcccccggaggggcgccccaatctctcccccctcccccgctttcttttgttccccaagggggcccctcccctatatatggggcggccccctatttataatacccccagcggcaccgccgggcgccgcgctttttataccgaccgccgtcgctctcgcttggcgcaacaaccctctttctacccttggggacaccccttcgggagacgggcccccttctcccgccgggggccgcgcgcgcccttcggtgggcccccacaccccctctcctcgggcgaacttttttataacccctccggaggagcccaccttctcagccctctttgcggcgctctatgagcgcgtcttaccaccgcgtcccgttagatttcccctctcgccgcttgacacatcgttcgccactcgcgccctttcttctcgtgcggcattttcctccgga

SEQ ID NO: 302868 - DNA, 951 bp, Homo sapiens
tagcgggggtcagctccgcccaccctccccggctccgcccgcctcccgggtcagcggcgcgggtgctgcgcctagctgcgcaccatggccgggttgctggcgttgctgggtccggcaggcagggtgggcgcccgggtccggcctcgcgccacctggctcctgggcgccaccgccccctgcgccccgccgcccctggccctggccctgctcccgcccaggctagacgcccggctgctccgcacggcgcgcggggactgccgcggccaccaggaccccagccaggccacggggacaacaggcagcagcgtcagctgcacagaggagaaaaagcaaagcaagtcacagcaactgaaaaagatttttcaagagtatggcactgttggcgtgtcattgcacattggaatctcattaatttccttgggcatattttacatggttgtgtcaagtggtgtggacatgcctgcaatcctgctgaaactcggatttaaagagtccctggtacagtcaaaaatggcagcaggcacaagtaccttcgtggtggcctatgcaatccacaagctgtttgcgccagtgagaatcagcattacgctagtctctgtgcccttgattgtcagatattttcgaaaagtgggattttttaaacctccagctgcaaaaccttaatgaactcttcagtcgtacacactgaaaacctatttcttctaaattacatgatttggattggttttagggttttagggttgtagggtttcttttggagaggtagggggctaattgctatgttctcatggataaactttgccagcaaaaatcaggcttttgaacaattttaattttttgcctcataaattttgtgaattcaccagcaagatgtacagaacgcctgtgtttacattgtttttatggaactagcagaataaaacatctattttaaaaatgaaaaaaaaagtt

SEQ ID NO: 302869 - DNA, 317 bp, Homo sapiens
ccaggggtccaaacagaaaataaccagagagagcaatgtggctatgtggtatgatttgttttattgcttgcccgctcagcacgctcctgttactcctaacaaaaagccacattgctctctcctaagccccaaccccactccactcctgtggccaggggtccaaacagaaaataaccggagaagacaaggaggtcaaaggatcagggaactaagcattatgtgaattcaccagcaagatgtacagaacgcctgtgtttacattgtttttatggaactagcagaataaaacatctattttaaaaatgaaaaaaaaagtt

SEQ ID NO: 302870 - DNA, 388 bp, Homo sapiens
aaatactgtaaatcttatagccaaatcaatttcttcatttaatcccttgctgtaataattgttttctttgcttcttcccccctagtggtgtggacatgcctgcaatcctgctgaaactcggatttaaagagtccctggtacagtcaaaaatggcagcaggcacaagtaccttcgtggtggcctatgcaatccacaagctgtttgcgccagtgagaatcagcattacgctagtctctgtgcccttgattgtcagatattttcgaaaagtgggattttttaaacctccagctgcaaaaccttaatgaactcttcagtcgtacacactgaaaacctatttcttctaaattacatgatttggattggttttagggttttagggttgtagggt

SEQ ID NO: 302871 - DNA, 326 bp, Homo sapiens
cattacattggtttgggggaagaaaagtagttctggtatgtttcattgatccccagataccttccaatctggacatgatggggctgattccagatggtttttctgaaatttcattaaggtaggtcagcgtcatttgtctctgtttaggtaaaatataaaaaccctgcccagtagcagtggcatcgcttggttcctgatgcccatgttccagaggaattcggataccacaaacagctaagacaatctcagcttttcttagacaatcttctatctcaaacttcagacattccagaattgtcatgatgtttacactgtctgagttaaaa

SEQ ID NO: 302872 - DNA, 1210 bp, Homo sapiens
agtagttgttgaaaaaaggtaggcggtgcctgaggcatccaatgacaagcggctccttgagaaagggggggggggtactccttgaaagcattgtccaatgaaaattaccaacggcagacacggagacagcgccggggcggagggtacgatggagaatttcacggcactgtttggggctcaggctgacccaccaccgcccccaaccgcactcggcttcggaccaggaaagcctccacccccgccaccgcctcctgcgggcgggggacccggcacggccccgcctcccaccgcggccacggctcctcctggcgcggacaagtcaggagctggctgtggccctttttacctcatgagggaactgccaggtagcacagagctgacaggcagcacgaatctgatcacacactacaacttggaacaagcctataataaattctgtgggaagaaggtgaaggagaagctaagtaacttcctgcctgacctgccagggatgattgatctgcctggttcccatgataacagcagcctccgctctctcattgagaagccccctattctcagtagctctttcaatcctatcacagggaccatgctggccggcttccgcctccacactggcccgttgccggagcagtgtcgtctgatgcatattcagcctcccaagaagaagaataagcacaagcacaaacagagccgtacccaggatcctgtccccccagaaacaccatctgattcagatcacaagaagaagaaaaagaaaaaagaagaggatcctgaacggaaaaggaagaagaaagagaagaagaaaaagaagaatcgacatagtccagaccacccaggtatgggcagctcccaggccagcagcagcagcagcctacgctaataggaccactggactctttgccaggatggcttttcctgctgtactgaacctgctgataaaagctgccttccaggctcttggacactgccttgggagcatcctgcagctgggacagaggccagctcctgttgggctcagttgagactaagtaaattaggagagagagggacatgcttttgtaggctcatcccagttggttttctcatggacatctcttcctctcccaggaagcttacaattttcttctctctcttttgtgcaatttgtctgatttaggacttgttctgtgttttctttaaaaaaaaaaattacatttatcaaactgga

SEQ ID NO: 302873 - DNA, 441 bp, Homo sapiens
aaggctagttcctagttgttcttaccctgcttctttctcccccagaatcgacatagtccagaccacccaggtatgggcagctcccaggccagcagcagcagcagcctacgctaataggaccactggactctttgccaggatggcttttcctgctgtactgaacctgctgataaaagctgccttccaggctcttggacactgccttgggagcatcctgcagctgggacagaggccagctcctgttgggctcagttgagactaagtaaattaggagagagagggacatgcttttgtaggctcatcccagttggttttctcatggacatctcttcctctcccaggaagcttacaattttcttctctctcttttgtgcaatttgtctgatttaggacttgttctgtgttttctttaaaaaaaaaaattacatttatcaaactgga

SEQ ID NO: 302874 - DNA, 1036 bp, Homo sapiens
agtagttgttgaaaaaaggtaggcggtgcctgaggcatccaatgacaagcggctccttgagaaagggggggggggtactccttgaaagcattgtccaatgaaaattaccaacggcagacacggagacagcgccggggcggagggtacgatggagaatttcacggcactgtttggggctcaggctgacccaccaccgcccccaaccgcactcggcttcggaccaggaaagcctccacccccgccaccgcctcctgcgggcgggggacccggcacggccccgcctcccaccgcggccacggctcctcctggcgcggacaagtcaggagctggctgtggccctttttacctcatgagggaactgccaggtagcacagagctgacaggcagcacgaatctgatcacacactacaacttggaacaagcctataataaattctgtgggaagaagttgccggagcagtgtcgtctgatgcatattcagcctcccaagaagaagaataagcacaagcacaaacagagccgtacccaggatcctgtccccccagaaacaccatctgattcagatcacaagaagaagaaaaagaaaaaagaagaggatcctgaacggaaaaggaagaagaaagagaagaagaaaaagaagaatcgacatagtccagaccacccaggtatgggcagctcccaggccagcagcagcagcagcctacgctaataggaccactggactctttgccaggatggcttttcctgctgtactgaacctgctgataaaagctgccttccaggctcttggacactgccttgggagcatcctgcagctgggacagaggccagctcctgttgggctcagttgagactaagtaaattaggagagagagggacatgcttttgtaggctcatcccagttggttttctcatggacatctcttcctctcccaggaagcttacaattttcttctctctcttttgtgcaatttgtctgatttaggacttgttctgtgttttctttaaaaaaaaaaattacatttatcaaactgga

SEQ ID NO: 302875 - DNA, 746 bp, Homo sapiens
agtagttgttgaaaaaaggtaggcggtgcctgaggcatccaatgacaagcggctccttgagaaagggggggggggtactccttgaaagcattgtccaatgaaaattaccaacggcagacacggagacagcgccggggcggagggtacgatggagaatttcacggcactgtttggggctcaggctgacccaccaccgcccccaaccgcactcggcttcggaccaggaaagcctccacccccgccaccgcctcctgcgggcgggggacccggcacggccccgcctcccaccgcggccacggctcctcctggcgcggacaagtcaggagctggctgtggccctttttacctcatgagggaactgccaggtagcacagagctgacaggcagcacgaatctgatcacacactacaacttggaacaagcctataataaattctgtgggaagaaggtgaaggagaagctaagtaacttcctgcctgacctgccagggatgattgatctgcctggttcccatgataacagcagcctccgctctctcattgagaagccccctattctcagtagctctttcaatcctatcacagggaccatgctggccggcttccgcctccacactggcccgttgccggagcagtgtcgtctgatgcatattcagcctcccaagaagaagaataagcacaagcacaaacagagccgtacccaggatcctgtccccccaggtaagaagcagttctattcaaagcaaa

SEQ ID NO: 302876 - DNA, 1449 bp, Homo sapiens
agtagttgttgaaaaaaggtaggcggtgcctgaggcatccaatgacaagcggctccttgagaaagggggggggggtactccttgaaagcattgtccaatgaaaattaccaacggcagacacggagacagcgccggggcggagggtacgatggagaatttcacggcactgtttggggctcaggctgacccaccaccgcccccaaccgcactcggcttcggaccaggaaagcctccacccccgccaccgcctcctgcgggcgggggacccggcacggccccgcctcccaccgcggccacggctcctcctggcgcggacaagtcaggagctggctgtggccctttttacctcatgagggaactgccaggtagcacagagctgacaggcagcacgaatctgatcacacactacaacttggaacaagcctataataaattctgtgggaagaaggtgaaggagaagctaagtaacttcctgcctgacctgccagggatgattgatctgcctggttcccatgataacagcagcctccgctctctcattgagaagccccctattctcagtagctctttcaatcctatcacagggaccatgctggccggcttccgcctccacactggcccgttgccggagcagtgtcgtctgatgcatattcagcctcccaagaagaagaataagcacaagcacaaacagagccgtacccaggatcctgtccccccaggtaaacccagttaagttccgtatggagctctggactcctaaattcccctgaagaagaaaccaatgtactgtggtctcttgggacttgggacagggactctagcagcacctctgtatcctttctggccatttggacaaaagcagttgccccgacttgggattttcctgtagtcttcagtggttcataacagtagaggattttgagctttacaggtgataggtacctaatgtctcctacagaaacaccatctgattcagatcacaagaagaagaaaaagaaaaaagaagaggatcctgaacggaaaaggaagaagaaagagaagaagaaaaagaagaatcgacatagtccagaccacccaggtatgggcagctcccaggccagcagcagcagcagcctacgctaataggaccactggactctttgccaggatggcttttcctgctgtactgaacctgctgataaaagctgccttccaggctcttggacactgccttgggagcatcctgcagctgggacagaggccagctcctgttgggctcagttgagactaagtaaattaggagagagagggacatgcttttgtaggctcatcccagttggttttctcatggacatctcttcctctcccaggaagcttacaattttcttctctctcttttgtgcaatttgtctgatttaggacttgttctgtgttttctttaaaaaaaaaaattacatttatcaaactgga

SEQ ID NO: 302877 - DNA, 380 bp, Homo sapiens
aatcaaaggaaaaatcttgagccttcaattgatgaaaaaacctccttagttgaaaaatgcaaaactctggcagactccttctgaggatgatgaagaaaagacaaaactctctgaaataattaaaactccgcaggagggatattattatatatggggttactagaaggggagtcaggattagggttgggattaggggagttattagacagggagtcagggcctcctgccatgggaacttcttgtcagtgatttcttcccttggccctgagataggcagcttggtggagaaggcttatacttcttagctgggtgaccttggataattcacttaatctcgctgggtctagatttcataatctgtaaatgaggataataggaag

SEQ ID NO: 302878 - DNA, 462 bp, Homo sapiens
cacaatggtttaacatttaccaagtacatttttgtttaccacacactgggctgtgtacgttacctgcagttacttcttttaaagctcccaaaccctgtaatgtaggttttattatcccgattttacagaggaagaaacaggtttaaggagattaggtaacttgcccagggtcatacaactagttagctctgaagcaggatctgaacctacctctcttacctttggagcccatcttgaactccaggtctgcttcttatccatctggttttccagggtttgcatttgagagcgtatcccccttcactggctgatgtagccctggttaagaaacatttctccatcccctgctgtggccctcaaaaggcagttgcagaccagtgatggatgaggtgaatccctggttggttttccagcaggctcaagaattgccagccagtgtgtgaaatcactcagtgaactgga

SEQ ID NO: 302879 - DNA, 747 bp, Homo sapiens
attcactcactggtgataacattcatgaatacgacatttttaatttgtatctcacctcatagaaagaattgtgcagcttttacatctgccagactagagttgaatattccagtctttacatgatttttttctccatctgtctgtctctttcctgtctctaattttgttggtgcatcaggactactgaacaagtgaaatttctctgttttctgttgtaagtactcctgctgtttctttagtccctgggaccgttggcagtttcctctctcccctcccccagccatctctccatagcatgtttgcttctaattctgagtttgatcttctgatgatttttttgcatttcatcagtcacttcatgagtcagcttagccttgcagttgtccatacctaagggagtggggcttggcctttacaccttaggtgctagagcttgcactccctggcttggcaggtgtcacgtggcgctttgacaataccaaaagctggcttggccccaagatcatcacagcagtggtttgagggactgttctgctatttaatattggaaatcattggcttttttggtagcataaagctactggcttggaacagttaataaattttactgagtcagctcaacttgagtttggtggcagagggtagcactcagtaagaagattagggaaagaagatcatgaactagtgattatgcacattccggtaacttatgtgcttgtctttgtattttttctcacaaaagaaaaa

SEQ ID NO: 302880 - DNA, 8128 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302881 - DNA, 1143 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcaggcaagtacacggcgtccccgctgagatgcagacgcgcttgcctccatccatctgcgactccctctgtgtgcgtgtgtgtggtcgccacccgcgaaaccgtcctcacggccgtgccgcgtccctgcccggagccgggtccccgtgtgcgtccgaaagttcaggatcttctgtcctcccgtggggtttctggcccccgtttcgctaggagagttccgcacccaacccagaatctgcagtctctccgcatccccgctggcctcggtcacttt

SEQ ID NO: 302882 - DNA, 435 bp, Homo sapiens
cctggttgtgtgctatttcagttcccagtcttaaatgcaaattgtaatagattgggtaaaactaagctttattgtactctagataattactaaagagattgaagcaaatgaatggaagaagaaatacgaagagacccggcaagaagttttggagatgaggttagactggaggttttggggaggggctggatacttttatgcactgttagatttgatacagatgaagtgatgacagtgtttgcttgccacagaaccaagtgttgagagcttgagggctttgctgtttgcaccttgctttgtgattgagaatgttatttcaggagttattgctaaccagttattatattcaaatactgtagtttatcttgggttgttcagaacatataacatgtaaacagaacccacataattcttatcttcttagaactgacagaa

SEQ ID NO: 302883 - DNA, 503 bp, Homo sapiens
  misc_feature (178)..(178): n is a, c, g, or t
cggggggcaatggcactccagctctgggccctgacctgcttgggcttgctgggcgcaggtgccagcctgaggccccgcaagctggacttcttccgcagcgagaaagagctgaaccacctggctgtgaatgaggcctcaggcgtggtgtacctgggggcggtgaatgccctctaccagntggatgcgaagctgcagctggagcagcaggtggccacgggcccggccctggacaacaagaagtgcacgccgcccatcgaggccagccagtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302884 - DNA, 184 bp, Homo sapiens
ccggctcacaacatgcacagccgcgctcacaacatgcacagccggctcacaacatgcacagtaatttccctttttatatgtcaagtaactatttgtaaaagttatactcacaaattattataatgattactaatatattttttccatgtttcattgcctgaataaaaactgtttaccactgtta

SEQ ID NO: 302885 - DNA, 8164 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgactactgaacaagtgaaatttctctgttttctgttgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302886 - DNA, 8111 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgactactgaacaagtgaaatttctctgttttctgttgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302887 - DNA, 7378 bp, Homo sapiens
gagagatgcgaaatcagcggtagcaggtggcgcagaagggagaggggagcgaccctggggaccgactctggggaccctcgccgaagagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgactactgaacaagtgaaatttctctgttttctgttgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302888 - DNA, 8295 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgactactgaacaagtgaaatttctctgttttctgttgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgttaaaaaaaaacaaacaccaaacgatagcaagagaacagcaaaggcggaaaagaaagcaacaaaggagggggggggcaaaaacacagggggaggaaaagggggcaattggagaggggccacaaggggtaaaagg

SEQ ID NO: 302889 - DNA, 8041 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302890 - DNA, 6898 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcaggagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302891 - DNA, 6135 bp, Homo sapiens
gatcacaagttgtgtgctaatctacaaataacagatggttcaagcttccccagtttcaggctttgtgcagcgtgtgacattcatcttccatcttactacttaataggaatggagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302892 - DNA, 6717 bp, Homo sapiens
tcccctctgcctcccaagtagctgggaccacaggcatgtgccaccatgcctgcataattttttttagagatgaggtctcgctctgttgcccaggctggtttgtaactcctgagctcaagcaatgcacctgcctcagcctcccaaagtgctgggattgcaggcatgagccacagcgcctggtccataatactttttaaaaattaattatgcatgagagtttcaaattacataaccaccaaatagatgatagaaagcttgttaacaagaaacaaaattgattgacttgaaatcgaaatctttttatttttcctcacttttagaaaggagagttatgagccatgaagtgactaaagatgaaatcaaagtagagaagaaaaaaaggcataaataattcacacacagtgtggtcaacacttgaatgattaaaaaacattttaagtatatccctctaatttgttgctcttttattatttgtcttttaagcatttcctaggtgtaaggccctttgctgggcttgatggaaaggaagggacattcctgctcttagagagcggtagccatccataataaccaacttggatatgacgtcaaaagtgatgggggcaccaccattgagggcaggggaggacgtgatgcgactcacagagcacccagcaccggactgggtcagaaggacattgtcattcttcactagaagaaaggttaacccaagaggttgatctttaaagtctttgaataagtgaaatacttttggaattaggacacaaaataaaacttgtcactgaatcagaggtagagtgtctgaaagggtggattgactcaggaaagtctaaagtcagatcgcatctgttaggaagagcccagaagaatatctttaacttagtttgtaaaagattgactcatctaagcagaatgaatctatttccttgcagtattcaaataggtgcaaagagaaagggaaggcagttggttctataagtaaaatataagtttgactaaagataaaatcttaacaaaaacctttttagaaccttaagaaaccttatataatgtaaaaaaaaaaaaaaaaaaaaagataacgagagccccaaagcagataaatggattacatacattgtcagtgtatgttaatgtgtttaattgtttgggacagcatttctccaactttcattgtctgaaaatcctcctctggtaataagttctttttttctcatttaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302893 - DNA, 5417 bp, Homo sapiens
tagaaaccatttgctagtgagatacaaattttgaagttgtctgtaaattgaatttttataaattaaaatggaattatttaggtcaccgatttttgttttttttctctcatgcagtcaattctttgaggcctgtgcctcacagatgtcagtggttagtatcctgactggctttgactagtggctaatcatgtgctttttgtctctttattacacccaaacaccataaacagagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302894 - DNA, 5991 bp, Homo sapiens
gggtgcagagaggaagttgcattttaactgaagttcagaacagcttcctagttggggtcatgagactgcctttctttctttctttgttttttatgcaatatattaatatgaagccatcttcccccttcattgctttagatcagtggtttgcagttgggggcagttttgccctccaggggatgttaggtgttaggtaatgtctggagatatatttgtttggttgtcaccactgggagatgctgctggtatctagtgcaggaagccagggatgctgttaaacatcctacaatgcacaggacagcctctgacaacacatttacccatcctaaaacatcagcagggctgctttgagaaactgctatagataaatgaaaaccaggactagcaacaatccctgtttctcactaagcagtttttagctttccgtttttatatgtctccggtgtattttctttactgcatttccaattatgtactcatacctgtgccatccattcatcaagagcaggagtttttatcacagggtctgttagcccctagaacggtgctccctgggagattcagactccagcatccctagatatgctaatggattgagtgagacccagatacttatgtttttgacaagtaccccaaataattcctctgataacaagaaaattggggaactaagagattcatggacaagtttcagagggctggtgactgtcctcaccctttactcaatttaagcatgattttatgagtacattttttgaggtgtgtagcctttttttctttaaagcatctctgatgtagaaaagttaaaaatcactgaattaggatgtctagggtagggtagatccagacttgggactagttaactctatttgcctttatttcagaatacaaagtggcctgcataattatgtcatttgtctttcagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302895 - DNA, 4660 bp, Homo sapiens
  misc_feature (2)..(2): n is a, c, g, or t
  misc_feature (51)..(51): n is a, c, g, or t
gngttggccgatctagacctagtggatcctccgggctgcatgaattcggcncgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302896 - DNA, 7894 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgactactgaacaagtgaaatttctctgttttctgttgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtacagcgccaggactgtgatggcatcacccatgtaacaccgtctctcctgtgatactctcagaacg

SEQ ID NO: 302897 - DNA, 7932 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgactactgaacaagtgaaatttctctgttttctgttgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaatttatccagtctgggacacgagactaagactcgaagatctaagccattccgcacgactccgcgatgaaccttagagacgaagccgttgtttgctgatgaactacccaagtatatatccactcctcaggtcactttttcagaccgtcgggataaggattaagacatgttcgtttgaatactgcgagcgtagtcagtagatttttctcataattagctccggtgcttgagtatggcagtcaccattgcacacgtctctaggatcctgcta

SEQ ID NO: 302898 - DNA, 6455 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgactactgaacaagtgaaatttctctgttttctgttgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacctatatcacaatcggggatcctcgaacct

SEQ ID NO: 302899 - DNA, 2304 bp, Homo sapiens
tttggagacggaatcttgctctgtgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302900 - DNA, 2102 bp, Homo sapiens
gtaaaactgggcttcccggtatttccagagcagttttacagaacaaaaggtttgggtaggtcacatggctggaaggagactctccaaccttgactgtgactatctgggcagccacggggggaatgttcagttggcctcacgttgcattccccacttaaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302901 - DNA, 1018 bp, Homo sapiens
acatgatagccatgagatgttggaaggggcatgagatgttggaaggagcaatgagatgtaggaaggccttccaacatagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 302902 - DNA, 5531 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaagggccaatatctgctactagcagtataaacttg

SEQ ID NO: 302903 - DNA, 3517 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaaccgctcaggtgtggtccctagtcacgacgtttgtttaatctgact

SEQ ID NO: 302904 - DNA, 3244 bp, Homo sapiens
  misc_feature (227)..(227): n is a, c, g, or t
  misc_feature (3224)..(3224): n is a, c, g, or t
  misc_feature (3231)..(3231): n is a, c, g, or t
  misc_feature (3235)..(3235): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttngtctccntccntctggtacc

SEQ ID NO: 302905 - DNA, 2674 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcag

SEQ ID NO: 302906 - DNA, 2673 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgactactgaacaagtgaaatttctctgttttctgttgtaagtactcctgctgtttctttagtccctgggaccgttggcagtttcctctctcccctcccccagccatctctccatagcatgtttgcttctaattctgagtttgatcttctgatgatttttttgcatttcatcagtcacttcatgagtcagcttagccttgcagttgtccatacctaagggagtggggcttggcctttacaccttaggtgctagagcttgcactccctggcttggcaggtgtcacgtggcgctttgacaataccaaaagctggcttggccccaagatcatcacagcagtggtttgagggactgttctgctatttaatattggaaatcattggcttttttggtagcataaagctactggcttggaacagttaataaattttactgagtcagctcaacttgagtttggtggcagagggtagcactcagtaagaagattagggaaagaagatcatgaactagtgattatgcacattccggtaacttatgtgcttgtctttgtattttttctcacaaaagaaaaa

SEQ ID NO: 302907 - DNA, 2304 bp, Homo sapiens
  misc_feature (227)..(227): n is a, c, g, or t
atcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccnggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgtgagtgacagtgggcgctgggtgtcgtgctctgtgtcttgtctgttgagtttggcagccagctacttttggctttggtgaactgaatttacctttgaggtgcaccgaggttcatacaaagcttataatgttatcctgcagtcttcactgtttggcttaactgttgtgtggaatcagaaataccagaggtttccttttca

SEQ ID NO: 302908 - DNA, 1702 bp, Homo sapiens
tcccctctgcctcccaagtagctgggaccacaggcatgtgccaccatgcctgcataattttttttagagatgaggtctcgctctgttgcccaggctggtttgtaactcctgagctcaagcaatgcacctgcctcagcctcccaaagtgctgggattgcaggcatgagccacagcgcctggtccataatactttttaaaaattaattatgcatgagagtttcaaattacataaccaccaaatagatgatagaaagcttgttaacaagaaacaaaattgattgacttgaaatcgaaatctttttatttttcctcacttttagaaaggagagttatgagccatgaagtgactaaagatgaaatcaaagtagagaagaaaaaaaggcataaataattcacacacagtgtggtcaacacttgaatgattaaaaaacattttaagtatatccctctaatttgttgctcttttattatttgtcttttaagcatttcctaggtgtaaggccctttgctgggcttgatggaaaggaagggacattcctgctcttagagagcggtagccatccataataaccaacttggatatgacgtcaaaagtgatgggggcaccaccattgagggcaggggaggacgtgatgcgactcacagagcacccagcaccggactgggtcagaaggacattgtcattcttcactagaagaaaggttaacccaagaggttgatctttaaagtctttgaataagtgaaatacttttggaattaggacacaaaataaaacttgtcactgaatcagaggtagagtgtctgaaagggtggattgactcaggaaagtctaaagtcagatcgcatctgttaggaagagcccagaagaatatctttaacttagtttgtaaaagattgactcatctaagcagaatgaatctatttccttgcagtattcaaataggtgcaaagagaaagggaaggcagttggttctataagtaaaatataagtttgactaaagataaaatcttaacaaaaacctttttagaaccttaagaaaccttatataatgtaaaaaaaaaaaaaaaaaaaaagataacgagagccccaaagcagataaatggattacatacattgtcagtgtatgttaatgtgtttaattgtttgggacagcatttctccaactttcattgtctgaaaatcctcctctggtaataagttctttttttctcatttaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaagtaagagcttgtaaatgttgaatttcactcttcatgatgttgtgggaagattgagagaggaaaacaaaatcactgtttcgcaactccaggttgtatttttatgtgtgtgtttatttcactttttaaacccttttcccattgttaaaacattaaaaagtaaaaaaaggtatat

SEQ ID NO: 302909 - DNA, 246 bp, Homo sapiens
atcacaagttgtgtgctaatctacaaataacagatggttcaagcttccccagtttcaggctttgtgcagcgtgtgacattcatcttccatcttactacttaataggaatggtaacagtttactcacatatttttacttttatactttttattgatgacagttcttctctgtgagcacacaagtctaactggaactgttttatgagacgtctatggcttttagtgcaataaagaatttttaaagaat

SEQ ID NO: 302910 - DNA, 377 bp, Homo sapiens
actttctcccttttagatcagaataaaattctctaggttatctgctcaacagaagctaagaccactctgatagtcattataacagtttttctttagttacttccataattagatttgttttttaaaaagcttccccccgctgacttttctttaaacatggttttaaaggatgtgatcaatttagtaatgaggaagttgttgaaggatgtctggggttaagaagctgaaagctgacagattcagtgtaatccctttccccacaggggctgctggagtcctctgcagagaaggcccctgtgtcggtgtcctgtggaggtgagagccccctggatgggatctgcctcagcgaatcagacaagacagccgtgctcacctta

SEQ ID NO: 302911 - DNA, 3919 bp, Homo sapiens
ggcacgaggctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaa

SEQ ID NO: 302912 - DNA, 4028 bp, Homo sapiens
ggcacgaggctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggccgaaagggaatatgtctttaaaaatttgcctttcaaagtataacggaggagcagttctatatttattctggggctatctacttcaaatactagaatcgtttccaaaagatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaa

SEQ ID NO: 302913 - DNA, 3744 bp, Homo sapiens
ggcacgaggctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgtt

SEQ ID NO: 302914 - DNA, 2343 bp, Homo sapiens
tttacacatttaatggcctaggatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaa

SEQ ID NO: 302915 - DNA, 2558 bp, Homo sapiens
  misc_feature (10)..(10): n is a, c, g, or t
  misc_feature (17)..(17): n is a, c, g, or t
  misc_feature (24)..(24): n is a, c, g, or t
  misc_feature (33)..(33): n is a, c, g, or t
  misc_feature (47)..(47): n is a, c, g, or t
  misc_feature (49)..(49): n is a, c, g, or t
  misc_feature (121)..(121): n is a, c, g, or t
gggaatgacnatacttngtagcangaggatgcnaacgtgcatgtgcnanagctttgaaaaagaaaaagaagatgccaaagcttcgctttgccagtagaatccggaaaattcggaagaagcnattttgaacattcttaatatgtcatcttgtttgtctttatggcttatttgcctttatggttgtatctgaagaataatatgacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaa

SEQ ID NO: 302916 - DNA, 3098 bp, Homo sapiens
ggcacgaggctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagctccagtccggggatcctctataatcgcggcagaca

SEQ ID NO: 302917 - DNA, 3089 bp, Homo sapiens
ggcacgaggctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgaggtgggatttgcgtgcaaaactggttac

SEQ ID NO: 302918 - DNA, 3367 bp, Homo sapiens
ggcacgaggctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatggtaatgcctcccagcctctgctcccagaaaccacagtgggccagggcttggaaagctggggagaggctagggcaagggggaggcattttatccactactgtgatggttaagacttgaagtcctgtgcaaaagttttaacatacgaccattagcttcctgtgtcattcttttgattttgaatgataaaacctttcttcccacatgtaactggaagtccagctgtaagacaggctctaactaagcatgtgatccaatcactggatcagtaatgtcctcaggggctgggtgctgtggctcatgcaggtaatcccagcactttgggaggccgaggcaggtggatcgcttgaggtcaggagttcaaaaccagcctggccaacgtgatgaaaccctgcctgtactaaaagagacttaggccagcgaggtggctcatgcctgtaattccagcactttgggaggcaaatgcggtcaaatcacttgaggtctgtaattcaagaccagcctggccaacatggcgacaccccatctctactaaaaatacaaaatttagccagctgtggtggcacatacctgtaatcccagctacttgagagactgaggcaggagaatcacttgaaccgggagatggagtttgcagtgagccgagatggtgccactgtactccagcctgggtgacagagcaagactctgtctccaaaaaaaaaaaaaaaaaaaaaaaaaaagacatttcaagctggaagatttggttccctaactttgagcctagctctttcattaaagtaataataaaagtagaactctacatttatataatggttttgactttccaaagtgattttcacatctcagcagtcctgtgaaggactaaataaggtgtttcagggtagacttggcattgtgttttgcaa

SEQ ID NO: 302919 - DNA, 2033 bp, Homo sapiens
ggggaatacccgccattggaaatgcctagggggtggccaaattcccaaatattgcaaaaaaaggtcttcccttagaaaaccgggttttgttaccaaagaaaggggttggaaggaagaagtcagttcatggggccaaagcaaagtttttagggaccctttttttttttttttttgaaagtgtgttagcatcaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaa

SEQ ID NO: 302920 - DNA, 1722 bp, Homo sapiens
ccactactgaccacaagttgccacaaaacttctgactttctttctctttacctttcaggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaa

SEQ ID NO: 302921 - DNA, 2909 bp, Homo sapiens
ggcacgaggctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaagtatgtagcttgtagttgtttcattccactttcccgaagttcctcttagctccggaatgagtatgcgagatgttaggcagccctcctgctgcctcgtggggttagccctggaggcctcccgcatctctcctttgattagcgtggcaaacactcggactgtctggacagagcatctggcgatggtagttctcacatggaggtcccataggctaaaggagcatttttaatttttccaggtcaggccatctaactgaccaagtagggctggattgtgtacttagagaagcagggtgcagtgtgagtgaaagaggcgaactgacctcttccctgcgtcgtcccgttatgtcatctcatctaagatgcagcagtttttgtattggattagatatttagtgaagaaacagaatctttattcatttaagaattaagtctttttgaggaaactgatgagctttttcagcgtgactgtccaaattcttccatgttgctctttgaaaggaccatttctagaacacttgccctcatacaaaccaaattcccaatttgctcaggtttctctaccttt

SEQ ID NO: 302922 - DNA, 2295 bp, Homo sapiens
ggcacgaggctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaactccagacaaacttcccagacaagctcctttgtgcctctacgtggagagggtgtggaaagttatcacattaaaagatggaggatttgctctgtt

SEQ ID NO: 302923 - DNA, 2126 bp, Homo sapiens
ggcacgaggctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggtaagtggtatgcagcttactcattggaggagagtggctgccagcatc

SEQ ID NO: 302924 - DNA, 1570 bp, Homo sapiens
ggcacgaggctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaa

SEQ ID NO: 302925 - DNA, 515 bp, Homo sapiens
cattaattgttaccaatgaagtgtaaatgcatgctgtcttccccaggatgtggcagataaccagatagactctggggacctgatggagtgtctgatacagaacaaacaccagaaggacatgaacgagaagtgtgccatcggagttacccacttccagctggtcagtgacacctggctgccaatatcccatcatagctgcctggatgttgactgaatcctttccttttttggaacatcagagcacctctgatgttctgttaaaagtcatttttttccagccaggcgtggtggctcacacctgtaatcccagcactttgggaggctgaggtgggtggatcacttgaggccaggagttcaagaccaacctgagcaacatggtgaaactccgtctctactgaaaatacaaaattagccaggcatggtggcacacacctgtaatcccagctgtttcaaaggctgaggcaggagaattgcttgaacctgggaggcggaggttgtagtgagccgagatcgcc

SEQ ID NO: 302926 - DNA, 756 bp, Homo sapiens
cccggcgccacccaccaccatggacccccgtctgcccgcctgggcactggtgctgctgggccctgccctggtgttcgcgttgggccccgcgcccaccccagagatgcgtgagaagttgtgcggccaccacttcgtacgcgcgctagtgcgcgtgtgcgggggcccccgctggtccaccgaagccaggaggcctgcggccggaggcgaccgtgagttgctacagtggctggagagacgacatctgctccatgggctggtggccgacagtaatctcacgctgggacctggcctgcagcccctgccccagacctctcaccatcaccgccaccaccgtgcagctgccaccaaccctgcacgctactgctgcctcagtggctgtacccaacaagacctgctgaccctctgtccctactgattcctccttgggtgcagcctcagagtggcctgaggcccagagggtctggtctggtgagctcctgaggccacacagcaccataaagtctcgcatctacaggcctttgattacctcctgggatgggtgctcactatctaccccagaccaatgccacctgcagcctgtggagtcaactgcagaataaatcacaccctagccctggcttggaggatccccgctttcacagatgctggacactgacagccaaatgtcctcactccagaggagccccagacgctccgctccctgcatgtgtaacaccccttcttgctgtctcttagtaaataaacgacccaaagcag

SEQ ID NO: 302927 - DNA, 778 bp, Homo sapiens
cccggcgccacccaccaccatggacccccgtctgcccgcctgggcactggtgctgctgggccctgccctggtgttcgcgttgggccccgcgcccaccccagagatgcgtgagaagttgtgcggccaccacttcgtacgcgcgctagtgcgcgtgtgcgggggcccccgctggtccaccgaagccaggaggcctgcggccggaggcgaccctgagtttcactctgtccccaggtgagttgctacagtggctggagagacgacatctgctccatgggctggtggccgacagtaatctcacgctgggacctggcctgcagcccctgccccagacctctcaccatcaccgccaccaccgtgcagctgccaccaaccctgcacgctactgctgcctcagtggctgtacccaacaagacctgctgaccctctgtccctactgattcctccttgggtgcagcctcagagtggcctgaggcccagagggtctggtctggtgagctcctgaggccacacagcaccataaagtctcgcatctacaggcctttgattacctcctgggatgggtgctcactatctaccccagaccaatgccacctgcagcctgtggagtcaactgcagaataaatcacaccctagccctggcttggaggatccccgctttcacagatgctggacactgacagccaaatgtcctcactccagaggagccccagacgctccgctccctgcatgtgtaacaccccttcttgctgtctcttagtaaataaacgacccaaagcag

SEQ ID NO: 302928 - DNA, 666 bp, Homo sapiens
cccggcgccacccaccaccatggacccccgtctgcccgcctgggcactggtgctgctgggccctgccctggtgttcgcgttgggccccgcgcccaccccagagatgcgtgagaagttgtgcggccaccacttcgtacgcgcgctagtgcgcgtgtgcgggggcccccgctggtccaccgaagccaggaggcctgcggccggaggcgacctgccccagacctctcaccatcaccgccaccaccgtgcagctgccaccaaccctgcacgctactgctgcctcagtggctgtacccaacaagacctgctgaccctctgtccctactgattcctccttgggtgcagcctcagagtggcctgaggcccagagggtctggtctggtgagctcctgaggccacacagcaccataaagtctcgcatctacaggcctttgattacctcctgggatgggtgctcactatctaccccagaccaatgccacctgcagcctgtggagtcaactgcagaataaatcacaccctagccctggcttggaggatccccgctttcacagatgctggacactgacagccaaatgtcctcactccagaggagccccagacgctccgctccctgcatgtgtaacaccccttcttgctgtctcttagtaaataaacgacccaaagcag

SEQ ID NO: 302929 - DNA, 1547 bp, Homo sapiens
ctcgctgcagcctgagctctaggtcttgttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctgggtattactgtttctaagccagacctgatcacttgtctggagcaagggaaagaggcctggagtatgaagagacatgagatcatggtggccaaacccacagaatcttactctgtcacccagtctggaatgcagtagcaagattttggcccactgcagcctcaaccttctggggtcaagtgattgttccacctcagcctcccgagaagcttggactacagacatgcagtactatgcctggctaattttttgattatttgtagagacagagtctcactttgttgcccagtctagtctcaaacttctggctccaaatgatcctcctaccttggtctcccaaagtgttgggattataggtatgagcctgttcacccagccagtattcttaaatttaataagatttgttatgtgtcctaacagaatacacaaggtgcaaataagaatgttgtgtattctcttgcttttgactgaaaagttttgtacatgtctgttaatcctagttggtctgtgatgtggtttagatgttcgtgttcttcaaatcttatgctgcaatgtaatcctcactgttggatgtggaacctggtgggagatgtttagatcatggggcaaatttctcatgaatggctttgtactatcctcttggtaatcaaaaagtttacactctgttaattcagatgagagctgcctcattaaaagaacctggccccttcacctcacatttggttctgtcttttactatgtgatatgtccagttactgttggccttccaccattgtggaagcttactgaaaccttccaccagaggcagatgccggcacacacttcttgtacagtctgcccaacgatgaaccaaacaagcctttttatttataaattatccactctcaggtattcctctatgtgcaaaataatatattctgtaacgttgtctaagttttctgttttcttattgatcttttctctgaattttctatttattattaaaaatggggtcttgatgtctacaattattatgttgctatgtatttcttgtttcacttttgtcaatatttgctttacgtattttggagccctaatgttgtatatacatatacacataaataaataggcataatagttttagattcctggtaaattgatccattttactattgtataatatcagtctttgtctcatgctagtacttgacttaaagcatataatgtctaatataattatgagtgtcttactcaattgtggttatatttgcatgtaataaaaagtttttccattctgttact

SEQ ID NO: 302930 - DNA, 2335 bp, Homo sapiens
ctcgctgcagcctgagctctaggtcttgttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctgggtattactgtttctaagccagacctgatcacttgtctggagcaagggaaagaggcctggagtatgaagagacatgagatcatggtggccaaacccacagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttaaatggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatggaattactgtcaaaa

SEQ ID NO: 302931 - DNA, 2236 bp, Homo sapiens
ctcgctgcagcctgagctctaggtcttgttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctggttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttaaatggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatggaattactgtcaaaa

SEQ ID NO: 302932 - DNA, 2141 bp, Homo sapiens
agcggagcgacttagaactttctaaaagaggcaaaggcagaggagaacaaaggaaggagggagcaacttgtggatgctgagaaaggttgtctatcaaaaagaatgtcgtatgagctattgagaaaggtgtatatcctgatgttactgaggagtgttctctatgcctctgttagaattatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttaaatggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatggaattactgtcaaaa

SEQ ID NO: 302933 - DNA, 2051 bp, Homo sapiens
agcggagcgacttagaactttctaaaagaggcaaaggcagaggagaacaaaggaaggagggagcaacttgtggatgctgagaaagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttaaatggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatggaattactgtcaaaa

SEQ ID NO: 302934 - DNA, 2746 bp, Homo sapiens
agcggagcgacttagaactttctaaaagaggcaaaggcagaggagaacaaaggaaggagggagcaacttgtggatgctgagaaaggtaaaaacacctccagataaggaataggaacaggctatgacctaatgcttgcttggaccagtataagcatgccagggcaaatatttaggctaaaatgtgggagctaagaacacaaagtacattgatttctttatcacggctagcagatatctaagaatgtcagcacaggtgtttgaatacattttgcttctaagagaagttactatttattcctaattacacgaggaggaaagtccctttgaaaaggaacctctatttcacattttacgatgagcacaatatagttttgcattggtgtatatgaatttgaatgagcaaacagctcttcaagtttttggggtatttttgtttgttttgttttttgggttttcgttttttgtttttgagacggagtctcactctgtcatcaggctggagtgcagtggcacgatctcggctcactgcaacctccgcctcctgcgttcaagtattcccctgcctcagcctcccaagtagctgtgactaaagccgtgcaccacaacgtctggccaattttttgtatttctagtagagacgaagtttcaccatattggccaggcgagtctcaaactcctgacctcgtgatccacccacctcagcctcccaaagtgcttggattatagacatgagcctcagcgcccagccctcttcaagtttttataaaccagtttcagaagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttaaatggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatggaattactgtcaaaa

SEQ ID NO: 302935 - DNA, 2425 bp, Homo sapiens
ctcgctgcagcctgagctctaggtcttgttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctgggtattactgtttctaagccagacctgatcacttgtctggagcaagggaaagaggcctggagtatgaagagacatgagatcatggtggccaaacccacaggttgtctatcaaaaagaatgtcgtatgagctattgagaaaggtgtatatcctgatgttactgaggagtgttctctatgcctctgttagaattatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttaaatggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatggaattactgtcaaaa

SEQ ID NO: 302936 - DNA, 832 bp, Homo sapiens
ttctctggggcccttgtgtggtgtggcgcttttccgtcctctcttctagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttaaatggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatggaattactgtcaaaa

SEQ ID NO: 302937 - DNA, 1036 bp, Homo sapiens
tcaacacaacttgcttctctccagacttgggcttaaggctctgataaccatgaggcttctcattctcacctgtcttgtggctgttgctcttgccaggcctaaacttcctcttagatacccagaacgccttcagaatccatcagagagcagtgagcctataccattagaatcaagagaggaatacatgaatggtatgaacaggcagagaaacattctgagagaaaaacagactgatgaaatcaaggatactaggaatgagtctactcagaactgtgttgtggcagagcctgagaagatggaatccagcatcagttcatcgagtgaggaaatgtctctcagtaagtgtgcggaacagttttgtagactgaacgaatacaaccaacttcagctgcaagctgtccatgcccaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagtttcttgtggacattttgtttaaaaagtctttgaattgccagttctgtaagtgccatcaattaaaatagttttgtgcagtgacagagattttcttttttcttttcaataaattacgatggcaggccggaacatacgcgccgattatacctcaccaaaccctcgggatatatcacacaatcg

SEQ ID NO: 302938 - DNA, 1013 bp, Homo sapiens
tcaacacaacttgcttctctccagacttgggcttaaggctctgataaccatgaggcttctcattctcacctgtcttgtggctgttgctcttgccaggcctaaacttcctcttagatacccagaacgccttcagaatccatcagagagcagtgagcctataccattagaatcaagagaggaatacatgaatggtatgaacaggcagagaaacattctgagagaaaaacagactgatgaaatcaaggatactaggaatgagtctactcagaactgtgttgtggcagagcctgagaagatggaatccagcatcagttcatcgagtgagggaacagttttgtagactgaacgaatacaaccaacttcagctgcaagctgtccatgcccaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagtttcttgtggacattttgtttaaaaagtctttgaattgccagttctgtaagtgccatcaattaaaatagttttgtgcagtgacagagattttcttttttcttttcaataaattacgatggcaggccggaacatacgcgccgattatacctcaccaaaccctcgggatatatcacacaatcg

SEQ ID NO: 302939 - DNA, 952 bp, Homo sapiens
tcaacacaacttgcttctctccagacttgggcttaaggctctgataaccatgaggcttctcattctcacctgtcttgtggctgttgctcttgccaggcctaaacttcctcttagatacccagaacgccttcagaatccatcagagagcagtgagcctataccattagaatcaagagaggaatacatgaatggtatgaacaggcagagaaacattctgagagaaaaacagactgatgaaatcaaggatactaggaatgagtctactcagaactgtgttgtggcagagcctgagaagatggaatccagcatcagttcatcgagtgaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagtttcttgtggacattttgtttaaaaagtctttgaattgccagttctgtaagtgccatcaattaaaatagttttgtgcagtgacagagattttcttttttcttttcaataaattacgatggcaggccggaacatacgcgccgattatacctcaccaaaccctcgggatatatcacacaatcg

SEQ ID NO: 302940 - DNA, 659 bp, Homo sapiens
aagtaatttagaatgtgtttccttttatgcaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagtttcttgtggacattttgtttaaaaagtctttgaattgccagttctgtaagtgccatcaattaaaatagttttgtgcagtgacagagattttcttttttcttttcaataaattacgatggcaggccggaacatacgcgccgattatacctcaccaaaccctcgggatatatcacacaatcg

SEQ ID NO: 302941 - DNA, 759 bp, Homo sapiens
gccaaaattcatcttcagcgcaggttcttcttcaaacagtggcggaggttctggaatcccacagcctcctccgggaatgagcttttatgcagccaaacgagttattggtgataacccatggacacctgaacaattggaacaggtatcacacaaggcttgctcataatagtagttgattgtggacactttcccctatgaagttcatgaaccgtataaaacataattctagtatattcaggctctccagtgaaatatgtttgaaagaagcagttgatgtaatgtgttcttttcatgctagttatttattaagccctaggggcagggaggagtgggacatactgtttagtttttctaatactgcttacatatgtcaagtataaagcacaactcacttataaattgaatatgtttaacttttgtcattttatttttttttattttttaacttttgtaattttaattttttaattataggtttaactttcatctagcttttatggtgcagttaaaatacaatttttcttacattattcaacttttaagggctgtacgttttatgtaaagtgaggagccccagcacttcacaggtgacaatgtggggaaaagcatgactccctgttatattacttcttgggaatttaaaaattggcattaaggattttattctggatttaaacaggacacagatgttctctgagcagcttttaaaaatgactggtgctctacagagaaggtgccttactgtgtctgtgtcatcag

SEQ ID NO: 302942 - DNA, 921 bp, Homo sapiens
cgcctgcctcggcctcccaaagtgctggctttataggcgccggctactgcacccagccctaaaccttttttaaagtgctttcttacatatttcctggtttgatcatcatctgttttgttctgtatttcacaaattggaggaccagtgcttagagagtgaaatgcattaccaaattttctgtttagttcttggcagacctaggactcaatctccgatctcattcctctgtgtctctgtagtgtcagagaaagtagattcacttattcttccctgtagatatgtgaagtagaaagtcttttgtcagatgaattctttattggatgcgcggtcactttcactaacgtccatgctctttgtatgtgaggtctgtgtgaaaatgtgtgaccctgccaaaggagcagctggccagagaaccatcgctgcccttctgccttgccttctggacaaaggaatgatgagcaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaaggtaagtgtactttccacaagaggaaatgtgcatcttcattagttctggccataaggatataacagccatcatgtttgaaattcatgttttaccacaaaatctaatattatacactaaccattttatttctgtggttgcactgataactgaaaacatgtaactggttcaagaaataaaacatctaactgttccagtaaaaaaa

SEQ ID NO: 302943 - DNA, 879 bp, Homo sapiens
gcggccgccgcctccgcctcccaggatgagctgaatcagcttgaacgggtctttttacgacttggccatgctgaaacagatgaacaattacagaatattatatctaaattccttcctcctgttttgctcaaactctctagcacccaagaaggagtacgtaaaaaggtaatggaactgctggtccatctgaataaacgtataaaaagccgccccaaaatacaacttccagtagagacactgttggttcagtaccaggaccctgctgcagtttcctttgtcacaaattttactataatttatgttaaaatgggctatcctcgcctaccagtggaaaaacaatgtgaactggcccctacgcttcttactgccatggaagggaagcctcagccacagcaggatagcttaatgcatcttttaataccaaccctttttcacatgaaataccctgttgaatcatcaaaatcagcttctccatttaatcttgctgagaaaccaaagactgtgcagctgcttttggacttcatgctagatgtccttctgatgccttatgggtgagttaaaaaataaaagcaaccttgttcttgactgcttttactacggggagttaagtactattttaaatgattaaactctcactagtaaatgaatgcatctcaacatccatttacgtttacaaagatttttttcttctaaacttcagctccactgcttatcggctttacaaatgctgagttgccattgtgattttagactctacctgcctaagatgaaatcagtctttccccataaaaatagttcctgttaggccaaggtgggacgattactgggggctaggagtttcagaccagcctgggtaacagagcgagactctctctcaaa

SEQ ID NO: 302944 - DNA, 504 bp, Homo sapiens
tttctttcagcaacacaaatttaatcttggaggttgtgtttttcaggcaggccatatgaactgtatgatatttctttttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtcgccaatcccggattggcgaccatttcaatatcctcctttgatgtccatttctctggtatgcctcctaccccagagctccagatgcctatccatggtgccttcttatatccttgaaatgtcgccaatccgggcgaccatttcaacctataggagatcc

SEQ ID NO: 302945 - DNA, 305 bp, Homo sapiens
atgagtcaagcagctgttgtgactccagttttttcttagtatatttctcttttcttctctgttactaagtggaataaataattccccaaataccagaaacagttggtccaaatttgtattacaagagacaacaacatatcaagagctctctataaatttacatctgtagtcttttgatctgcctatttagaaaggttcagagttgtgcctgtgcctaatagttatctttgggaggaactaggaaagttataagctgtggaggtatttaatgaagtaggtaacataaaggtatgtgaagagattgg

SEQ ID NO: 302946 - DNA, 6303 bp, Homo sapiens
gccaaaattcatcttcagcgcaggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacgaaaaaaaaaatg

SEQ ID NO: 302947 - DNA, 6279 bp, Homo sapiens
gcggccgccgcctccgcctcccaggatgagctgaatcagcttgaacgggtctttttacgacttggccatgctgaaacagatgaacaattacagaatattatatctaaattccttcctcctgttttgctcaaactctctagcacccaagaaggagtacgtaaaaaggtaatggaactgctggtccatctgaataaacgtataaaaagccgccccaaaatacaacttccagtagagacactgtgttgaaaccttccatagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacgaaaaaaaaaatg

SEQ ID NO: 302948 - DNA, 5096 bp, Homo sapiens
gccaaaattcatcttcagcgcaggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagcctta

SEQ ID NO: 302949 - DNA, 4197 bp, Homo sapiens
  misc_feature (51)..(51): n is a, c, g, or t
  misc_feature (54)..(54): n is a, c, g, or t
gacaagagtggggagactaaccctgtccagatctacattggcctgcttcanacntgtttagcaggtgttggaggtttgccggttatgtactgtctattggaagctgtgtcagtgtatccagaaaagctggctaccaaatttgtagacaaaacagaatggataaagattctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagcctta

SEQ ID NO: 302950 - DNA, 4972 bp, Homo sapiens
gccaaaattcatcttcagcgcaggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaac

SEQ ID NO: 302951 - DNA, 7721 bp, Homo sapiens
gccaaaattcatcttcagcgcaggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaaggtaagttgttgttagttctgactgggggaccataaagccatgtggcatatgttttagaaattttttgtttcgtttttgcttatactcttaagcatatactctgaaatacaaatcagtatgtatgcacatgcaagaagaatggacaaagccaaaactattaaattttactaaatatttaaatttgatacacttttatatatttttaatatattattaagctatagttgtcttaaagtaataaagtttttgttttcatcgtgaatcctgatttaatcttggttaattacaggaattggttgacagtggcatgtgtacatgtaaataagcagaacgacacactgaaaagtggagttggaaaaacatttttaacagttatctacctgagtcatcaaatctgacagtagcaattttcttaatcctatttcttctcccctaacctctttttcttctaatggtctatcagtgggtggggtgggggggaactgttagcattttctccagtggtgtatctgttactgacttcagaaggaggaccctcttcttttttctctctctctctcaaattgttttcacggattaagaatgtagaagatggaaacgtttttcctgcaaccttgtgtatttgctctttctacttctctatctttgcttagcaattaaaacacctctcttagggctccatcaaacagaacttttagactgagtaacgctaaacatctcctaatcccttttttccttgttgagataaaagagctaggcacttagtcgtattaccgaattctcagtttgccagatatgtactaatatagtccagatgaggaaaataaggctgaaggcaagctaaacttgcctgaagccacattgctaggaagtgacagaaccttgtaaacaagatttaagatttgatatactttcttattttctaaaaatttcaatgtgcatgtagttctcagatgctttcctcgaagaaaagggagtgtcatctatttatctgaccttgcaattatgacatttcttagaagttttttttttttaactgaccgtatcttatgaaatggtcttgcgatggtgttgttgaaatgacttttttgctgcagtgtgccttgccctgataattccttcttcctactatgcttcagtgtaattatttctcttactcccactgatactgggggaaggagaggaaactccctgatgtgcctctacgctactgtcaagaattaggttttgagacacatattgacagtatgtaatgataattatatactgatctgttatcaagaggttgctttgcatttatttgggggataggatatttttaaatttttttcttgcttgttctataaggattctttggggttttttctttttgctttgttttttgttttttttgtttttgttttttttttttcatgcagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacgaaaaaaaaaatg

SEQ ID NO: 302952 - DNA, 4007 bp, Homo sapiens
gtcggcccatgatgtccctaaaaatcttcttcatctcctatctagtatatagctatcctcctgtacacagcacctagaaatcctctgccgccggccggaaaggacttttatatcttgtacacagtaaatgcttgataggaagttttatcactttgtaaatgaatcgtattggctagttgaatgttggtatgaaaagcttgaagcttattgaaattattgttttggtttagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacgaaaaaaaaaatg

SEQ ID NO: 302953 - DNA, 3552 bp, Homo sapiens
cgcctgcctcggcctcccaaagtgctggctttataggcgccggctactgcacccagccctaaaccttttttaaagtgctttcttacatatttcctggtttgatcatcatctgttttgttctgtatttcacaaattggaggaccagtgcttagagagtgaaatgcattaccaaattttctgtttagttcttggcagacctaggactcaatctccgatctcattcctctgtgtctctgtagtgtcagagaaagtagattcacttattcttccctgtagatatgtgaagtagaaagtcttttgtcagatgaattctttattggatgcgcggtcactttcactaacgtccatgctctttgtatgtgaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacgaaaaaaaaaatg

SEQ ID NO: 302954 - DNA, 5781 bp, Homo sapiens
gccaaaattcatcttcagcgcaggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacgaaaaaaaaaatg

SEQ ID NO: 302955 - DNA, 6514 bp, Homo sapiens
gccaaaattcatcttcagcgcaggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaaggtaagttgttgttagttctgactgggggaccataaagccatgtggcatatgttttagaaattttttgtttcgtttttgcttatactcttaagcatatactctgaaatacaaatcagtatgtatgcacatgcaagaagaatggacaaagccaaaactattaaattttactaaatatttaaatttgatacacttttatatatttttaatatattattaagctatagttgtcttaaagtaataaagtttttgttttcatcgtgaatcctgatttaatcttggttaattacaggaattggttgacagtggcatgtgtacatgtaaataagcagaacgacacactgaaaagtggagttggaaaaacatttttaacagttatctacctgagtcatcaaatctgacagtagcaattttcttaatcctatttcttctcccctaacctctttttcttctaatggtctatcagtgggtggggtgggggggaactgttagcattttctccagtggtgtatctgttactgacttcagaaggaggaccctcttcttttttctctctctctctcaaattgttttcacggattaagaatgtagaagatggaaacgtttttcctgcaaccttgtgtatttgctctttctacttctctatctttgcttagcaattaaaacacctctcttagggctccatcaaacagaacttttagactgagtaacgctaaacatctcctaatcccttttttccttgttgagataaaagagctaggcacttagtcgtattaccgaattctcagtttgccagatatgtactaatatagtccagatgaggaaaataaggctgaaggcaagctaaacttgcctgaagccacattgctaggaagtgacagaaccttgtaaacaagatttaagatttgatatactttcttattttctaaaaatttcaatgtgcatgtagttctcagatgctttcctcgaagaaaagggagtgtcatctatttatctgaccttgcaattatgacatttcttagaagttttttttttttaactgaccgtatcttatgaaatggtcttgcgatggtgttgttgaaatgacttttttgctgcagtgtgccttgccctgataattccttcttcctactatgcttcagtgtaattatttctcttactcccactgatactgggggaaggagaggaaactccctgatgtgcctctacgctactgtcaagaattaggttttgagacacatattgacagtatgtaatgataattatatactgatctgttatcaagaggttgctttgcatttatttgggggataggatatttttaaatttttttcttgcttgttctataaggattctttggggttttttctttttgctttgttttttgttttttttgtttttgttttttttttttcatgcagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagcctta

SEQ ID NO: 302956 - DNA, 5292 bp, Homo sapiens
gccaaaattcatcttcagcgcaggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttaggtgagtgtagtaaactaaaactgatgagggagtcctaattttaaagctaaggagctgagcttcaaatatttcctactttgtcttaggaactaaatttctgaaatagctactggactctgctacttattatactccatgtgtaccccttaactggaatatttaaatctggaactataacaggattttagcatctagtttagaaaaaccttcgtgacaagtatttttacaaaattgttacttgaaagtaatttcaaacttacagaatggttgcaacgacagtacatgtaatactctgcaatatgtatacactttatgcagaatcatttgttaacattttgtgccatttgctttgtcatttggacttctatatacatgtttttctcctgaaccatttgaaagtatgttgcttacttcaggcccccttgttcctcaattatttagtgtgccacggtacagttgtcaactttaggtagtaaacatggatgcagttttttaaatcaaatgtttatcgttcatattctagtttgttcagttgattggtgacgtcatt

SEQ ID NO: 302957 - DNA, 2486 bp, Homo sapiens
ggggacctggcaaggctggtggctgtgctgcaaggcaaacactccacctatgacactgacctcttttccccgctgctcaacgccatacagcagggctgcagggcacccccttacttgggccgagtaggggtggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacgaaaaaaaaaatg

SEQ ID NO: 302958 - DNA, 1992 bp, Homo sapiens
tccctctctcacgatccttccctctctcccggtcttgttgctctgacattctcattttctttttagccaaataccttcccaccgtgaatcccaatgcaagcaaggatccatgctgtatctccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacgaaaaaaaaaatg

SEQ ID NO: 302959 - DNA, 3812 bp, Homo sapiens
  misc_feature (3790)..(3790): n is a, c, g, or t
gccaaaattcatcttcagcgcaggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcntggcttgctttcagcatggggt

SEQ ID NO: 302960 - DNA, 1964 bp, Homo sapiens
ggggacctggcaaggctggtggctgtgctgcaaggcaaacactccacctatgacactgacctcttttccccgctgctcaacgccatacagcagggctgcagggcacccccttacttgggccgagtaggggtggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacgaaaaaaaaaatg

SEQ ID NO: 302961 - DNA, 3876 bp, Homo sapiens
gccaaaattcatcttcagcgcaggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattgaaacttctaaaactaggcctagttttagaagtttcatagcacctagttttagaagtcccca

SEQ ID NO: 302962 - DNA, 1736 bp, Homo sapiens
ataatatattacatactgtcaatatgtgtctcaaaacctaattcttgacagtagcgtagaggcacatattgacagtatgtaatgataattatatactgatctgttatcaagaggttgctttgcatttatttgggggataggatatttttaaatttttttcttgcttgttctataaggattctttggggttttttctttttgctttgttttttgttttttttgtttttgttttttttttttcatgcagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacgaaaaaaaaaatg

SEQ ID NO: 302963 - DNA, 3746 bp, Homo sapiens
gccaaaattcatcttcagcgcaggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaaggtaagtgtactttccacaagaggaaatgtgcatcttcattagttctggccataaggatataacagccatcatgtttgaaattcatgttttaccacaaaatctaatattatacactaaccattttatttctgtggttgcactgataactgaaaacatgtaactggttcaagaaataaaacatctaactgttccagtaaaaaaa

SEQ ID NO: 302964 - DNA, 3672 bp, Homo sapiens
gccaaaattcatcttcagcgcaggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaaggtaagtgtactttccacaagaggaaatgtgcatcttcattagttctggccataaggatataacagccatcatgtttgaaattcatgttttaccacaaaatctaatattatacactaaccattttatttctgtggttgcactgataactgaaaacatgtaactggttcaagaaataaaacatctaactgttccagtaaaaaaa

SEQ ID NO: 302965 - DNA, 941 bp, Homo sapiens
tacaattgcatatgtacgagtggatgaacgtaccattggtgatcccgaggatttttgtcaagattggataaaccatgtatcacattgattgtagagatcagcttgaacgggtctttttacgacttggccatgctgaaacagatgaacaattacagaatattatatctaaattccttcctcctgttttgctcaaactctctagcacccaagaaggagtacgtaaaaaggtaatggaactgctggtccatctgaataaacgtataaaaagccgccccaaaatacaacttccagtagagacactgttggttcagtaccaggaccctgctgcagtttcctttgtcacaaattttactataatttatgttaaaatgggctatcctcgcctaccagtggaaaaacaatgtgaactggcccctacgcttcttactgccatggaagggaagcctcagccacagcaggatagcttaatgcatcttttaataccaaccctttttcacatgaaataccctgttgaatcatcaaaatcagcttctccatttaatcttgctgagaaaccaaagactgtgcagctgcttttggacttcatgctagatgtccttctgatgccttatgggtgagttaaaaaataaaagcaaccttgttcttgactgcttttactacggggagttaagtactattttaaatgattaaactctcactagtaaatgaatgcatctcaacatccatttacgtttacaaagatttttttcttctaaacttcagctccactgcttatcggctttacaaatgctgagttgccattgtgattttagactctacctgcctaagatgaaatcagtctttccccataaaaatagttcctgttaggccaaggtgggacgattactgggggctaggagtttcagaccagcctgggtaacagagcgagactctctctcaaa

SEQ ID NO: 302966 - DNA, 668 bp, Homo sapiens
gccaaaattcatcttcagcgcaggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagaccagctgcatggtacagagctcgattgtatcatgtaact

SEQ ID NO: 302967 - DNA, 434 bp, Homo sapiens
tggtttagacagtgtaaatgacatgtttgggcttaatagtatttcctcatctttcaaccccttaggaggagctattgaaagccattgcctgtgtggtgacagcttgcaggtaaatgttctttcaatgaagatgccatttcttaaactggacccgaaaactgcagcctttattaacttctgatgcttttgtatggaccctgtagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaaggtaataccacctgtatcctcagttctggtttatacttt

SEQ ID NO: 302968 - DNA, 517 bp, Homo sapiens
agttagacttgatgtttgcctttgttatagctacggattatttttttttaaagttctttagcttggaagtgaaagtcttttatgggtgtttgtgcggattattcctaattaattgaatgtgccgggtgactttaatttctcttctttaggctgcgatggatagtgctcggcttagtgctgccaaatcttctccaatgatggaaacaatcaacatggtgagtgtcttaaataataatgagagggtttgtttgcttacctgaaagtgtaattcttcaaagtcttcaggctatgttaaatgaagcagagacttatgggatgagtcaagcagctgttgtgactccagttttttcttagtatatttctcttttcttctctgttactaagtggaataaataattccccaaataccagaaacagttggtccaaatttgtattacaagagacaacaacatatcaagagctctctataaatttacatctgtagtcttttgatctgcctatttagaaaggttcagag

SEQ ID NO: 302969 - DNA, 4427 bp, Homo sapiens
ggcggaggcggggctggagtggtggaaggggggtggcaggtctgcattgccgcttccctggtgccgggagcagtcgccgctgccgcctccgcccgcggccgggacccccgtcctcgcccgggactccttacccggggaacctagaccaggtctccagaggcttgtggaagagaagcaggcgacccttcctgagttatcctggcttagcctcccaatctggctccccttccccttcccattcccctgctccccctgtcccttccccatccacccaactgaactgggtataggtcaaagctcctctccttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcagggcattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatgggtggagttttcagatgggttctgcctaccagttccatagctggagggtcttcgtcctcgtctgcgcctttccttctgtgtttgccattggggctctgaccacgcagcctgagagcccccgtttcttcctagagaatggaaagcatgatgaggcctggatggtgctgaagcaggtccatgataccaacatgcgagccaaaggacatcctgagcgagtgttctcagtaacccacattaagacgattcatcaggaggatgaattgattgagatccagtcggacacagggacctggtaccagcgctggggggtccgggccttgagcctaggggggcaggtttgggggaattttctctcctgttttggtcccgaatatcggcgcatcactctgatgatgatgggtgtgtggttcaccatgtcattcagctactatggcctgaccgtctggtttcctgacatgatccgccatctccaggcagtggactacgcatcccgcaccaaagtgttccccggggagcgcgtagagcatgtaacttttaacttcacgttggagaatcagatccaccgaggcgggcagtacttcaatgacaagttcattgggctgcggctcaagtcagtgtcctttgaggattccctgtttgaagagtgttattttgaggatgtcacatccagcaacacgtttttccgcaactgcacattcatcaacactgtgttctataacactgacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttgctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggaccacagcttttggcttcctgaatgccctgtgtaagctggcagctgtgctggggatcagcatcttcacatccttcgtgggaatcaccaaggctgcacccatcctctttgcctcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccctcactccccactccccgtgtttggtgtcttagctgtgtgtgcgtgtgcgtgtgcatgtgtgtaaaccccgtgggcagggactacagggaaggctccttcatcccagttttgagatgaagctgtactccccatttcccactgcccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttagagtctgaagagtgggcctcgggtgccctctcacatctcctgttggatgctgggggagaagcaataaacctcagccctctggcctccactttcctctcaatttgggctgcaaatatgaagcctgaattttatgaaattagctttctgattcttatttattaatagattaagttctgaggcagctccgcaggactgtgtgtgaatgtgtatgtatacttacatatgtgtgtgcatgtgccatggggcggggggtatcactatactgtcctcaaatataagccaagggtaatttcagcggatgcacacacaaccctgcctcccacagttcctcccctaatctggtttctgtgttgagcctgggatggaggagccctaggccagcctgggataagagtcccacagtctagggagatctgagggcatccgacaaggcccatctccttccctcctcaagaagcagaggcctcctctggagtgagaggctccacccactacagcacaggcgggaatagcacagctgccctcccatgctccctacctgtcccctcacagggaggggagcaggggagggaaagaaaccaggcatctggtcaaaccagcagatcaaaaagcacaaagagctggggcagaggcaggaagcaggggccctcctggcagctcctctgagtggggagaggttgggcagtgagtgagggacccctaatgcagggactagaagcctcagtttccccattttacccttccacacaatagcctctgtaggttaggctgccccatcccaccctactctgtgtggctgctttctttggtgccctcccctcaccccactgtagctgtgacgtgttgtagtttttagatgtttgtaaaatgtttaaaaaaatgttaaaaggaaaaaagtgaaaataacaaaaaagaaaatcaaaattcaccttcgtcatgctgcgtccagtgccccaaccctgtggtcactctccccattttgtaacactgtaccaggtggtgactgtttaactctttggtgtctgtgctcaaaagactgccttctccagtgcccagtgtatgagtgtgtgccctgtgcccttgtccctcactccccacatgctggacgtagccctcttcctcgcacccctgggagggacccatccatctcccttgctctcctggggaaccctaaacccaactctgttgatgtgaaaaatgcagtgaaaaatattgacgaaaaataaaacggaaacaaatcctcaaaataaaaaaaaaaaa

SEQ ID NO: 302970 - DNA, 2300 bp, Homo sapiens
gaacttacggctaggtacgaggctgggttgtaaatcggccgaggctgacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttgctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggaccacagcttttggcttcctgaatgccctgtgtaagctggcagctgtgctggggatcagcatcttcacatccttcgtgggaatcaccaaggctgcacccatcctctttgcctcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccctcactccccactccccgtgtttggtgtcttagctgtgtgtgcgtgtgcgtgtgcatgtgtgtaaaccccgtgggcagggactacagggaaggctccttcatcccagttttgagatgaagctgtactccccatttcccactgcccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttagagtctgaagagtgggcctcgggtgccctctcacatctcctgttggatgctgggggagaagcaataaacctcagccctctggcctccactttcctctcaatttgggctgcaaatatgaagcctgaattttatgaaattagctttctgattcttatttattaatagattaagttctgaggcagctccgcaggactgtgtgtgaatgtgtatgtatacttacatatgtgtgtgcatgtgccatggggcggggggtatcactatactgtcctcaaatataagccaagggtaatttcagcggatgcacacacaaccctgcctcccacagttcctcccctaatctggtttctgtgttgagcctgggatggaggagccctaggccagcctgggataagagtcccacagtctagggagatctgagggcatccgacaaggcccatctccttccctcctcaagaagcagaggcctcctctggagtgagaggctccacccactacagcacaggcgggaatagcacagctgccctcccatgctccctacctgtcccctcacagggaggggagcaggggagggaaagaaaccaggcatctggtcaaaccagcagatcaaaaagcacaaagagctggggcagaggcaggaagcaggggccctcctggcagctcctctgagtggggagaggttgggcagtgagtgagggacccctaatgcagggactagaagcctcagtttccccattttacccttccacacaatagcctctgtaggttaggctgccccatcccaccctactctgtgtggctgctttctttggtgccctcccctcaccccactgtagctgtgacgtgttgtagtttttagatgtttgtaaaatgtttaaaaaaatgttaaaaggaaaaaagtgaaaataacaaaaaagaaaatcaaaattcaccttcgtcatgctgcgtccagtgccccaaccctgtggtcactctccccattttgtaacactgtaccaggtggtgactgtttaactctttggtgtctgtgctcaaaagactgccttctccagtgcccagtgtatgagtgtgtgccctgtgcccttgtccctcactccccacatgctggacgtagccctcttcctcgcacccctgggagggacccatccatctcccttgctctcctggggaaccctaaacccaactctgttgatgtgaaaaatgcagtgaaaaatattgacgaaaaataaaacggaaacaaatcctcaaaataaaaaaaaaaaa

SEQ ID NO: 302971 - DNA, 2754 bp, Homo sapiens
gtgcggatcattgcatgaatccactcctttttaatagtgattctcaaacttcagtatatgcacacgaaatgctggttttgtgagctagactgaaatttcccacctcatactgggcgagctttttccatgttgcaggaaaacaacaatggataggactttttattattttaaatgtttttctcagaaaaatttcctaagtccacggcatcgctactgcttatagtcagctagcacggacagaaagaatgaataagcagctaagactattaatgggagaacttggacaaagtcacactgttggacagatgatggtcattttctgctctaaagatccctagttcccatggtgatgttatttgatgttttgtgattagcactgtgaataattttgagagcccctcctactaactttcatacatgcagagccctgagccataagccgtaacagcctccctctcccatctgctatgactgcctgcttatcttggcctttgcccacagacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttgctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggaccacagcttttggcttcctgaatgccctgtgtaagctggcagctgtgctggggatcagcatcttcacatccttcgtgggaatcaccaaggctgcacccatcctctttgcctcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccctcactccccactccccgtgtttggtgtcttagctgtgtgtgcgtgtgcgtgtgcatgtgtgtaaaccccgtgggcagggactacagggaaggctccttcatcccagttttgagatgaagctgtactccccatttcccactgcccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttagagtctgaagagtgggcctcgggtgccctctcacatctcctgttggatgctgggggagaagcaataaacctcagccctctggcctccactttcctctcaatttgggctgcaaatatgaagcctgaattttatgaaattagctttctgattcttatttattaatagattaagttctgaggcagctccgcaggactgtgtgtgaatgtgtatgtatacttacatatgtgtgtgcatgtgccatggggcggggggtatcactatactgtcctcaaatataagccaagggtaatttcagcggatgcacacacaaccctgcctcccacagttcctcccctaatctggtttctgtgttgagcctgggatggaggagccctaggccagcctgggataagagtcccacagtctagggagatctgagggcatccgacaaggcccatctccttccctcctcaagaagcagaggcctcctctggagtgagaggctccacccactacagcacaggcgggaatagcacagctgccctcccatgctccctacctgtcccctcacagggaggggagcaggggagggaaagaaaccaggcatctggtcaaaccagcagatcaaaaagcacaaagagctggggcagaggcaggaagcaggggccctcctggcagctcctctgagtggggagaggttgggcagtgagtgagggacccctaatgcagggactagaagcctcagtttccccattttacccttccacacaatagcctctgtaggttaggctgccccatcccaccctactctgtgtggctgctttctttggtgccctcccctcaccccactgtagctgtgacgtgttgtagtttttagatgtttgtaaaatgtttaaaaaaatgttaaaaggaaaaaagtgaaaataacaaaaaagaaaatcaaaattcaccttcgtcatgctgcgtccagtgccccaaccctgtggtcactctccccattttgtaacactgtaccaggtggtgactgtttaactctttggtgtctgtgctcaaaagactgccttctccagtgcccagtgtatgagtgtgtgccctgtgcccttgtccctcactccccacatgctggacgtagccctcttcctcgcacccctgggagggacccatccatctcccttgctctcctggggaaccctaaacccaactctgttgatgtgaaaaatgcagtgaaaaatattgacgaaaaataaaacggaaacaaatcctcaaaataaaaaaaaaaaa

SEQ ID NO: 302972 - DNA, 4770 bp, Homo sapiens
ggcggaggcggggctggagtggtggaaggggggtggcaggtctgcattgccgcttccctggtgccgggagcagtcgccgctgccgcctccgcccgcggccgggacccccgtcctcgcccgggactccttacccggggaacctagaccaggtctccagaggcttgtggaagagaagcaggcgacccttcctgagttatcctggcttagcctcccaatctggctccccttccccttcccattcccctgctccccctgtcccttccccatccacccaactgaactgggtataggtcaaagctcctctccttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcagggcattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatgggtggagttttcagatgggttctgcctaccagttccatagctggagggtcttcgtcctcgtctgcgcctttccttctgtgtttgccattggggctctgaccacgcagcctgagagcccccgtttcttcctagagaatggaaagcatgatgaggcctggatggtgctgaagcaggtccatgataccaacatgcgagccaaaggacatcctgagcgagtgttctcagtaacccacattaagacgattcatcaggaggatgaattgattgagatccagtcggacacagggacctggtaccagcgctggggggtccgggccttgagcctaggggggcaggtttgggggaattttctctcctgttttggtcccgaatatcggcgcatcactctgatgatgatgggtgtgtggttcaccatgtcattcagctactatggcctgaccgtctggtttcctgacatgatccgccatctccaggcagtggactacgcatcccgcaccaaagtgttccccggggagcgcgtagagcatgtaacttttaacttcacgttggagaatcagatccaccgaggcgggcagtacttcaatgacaagttcattgggctgcggctcaagtcagtgtcctttgaggattccctgtttgaagagtgttattttgaggatgtcacatccagcaacacgtttttccgcaactgcacattcatcaacactgtgttctataacactgacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttgctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggaccacagcttttggcttcctgaatgccctgtgtaagctggcagctgtgctggggatcagcatcttcacatccttcgtgggaatcaccaaggctgcacccatcctctttgcctcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccctcactccccactccccgtgtttggtgtcttagctgtgtgtgcgtgtgcgtgtgcatgtgtgtaaaccccgtgggcagggactacagggaaggctccttcatcccagttttgagatgaagctgtactccccatttcccactgcccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttagagtctgaagagtgggcctcgggtgccctctcacatctcctgttggatgctgggggagaagcaataaacctcagccctctggcctccactttcctctcaatttgggctgcaaatatgaagcctgaattttatgaaattagctttctgattcttatttattaatagattaagttctgaggcagctccgcaggactgtgtgtgaatgtgtatgtatacttacatatgtgtgtgcatgtgccatggggcggggggtatcactatactgtcctcaaatataagccaagggtaatttcagcggatgcacacacaaccctgcctcccacagttcctcccctaatctggtttctgtgttgagcctgggatggaggagccctaggccagcctgggataagagtcccacagtctagggagatctgagggcatccgacaaggcccatctccttccctcctcaagaagcagaggcctcctctggagtgagaggctccacccactacagcacaggcgggaatagcacagctgccctcccatgctccctacctgtcccctcacagggaggggagcaggggagggaaagaaaccaggcatctggtcaaaccagcagatcaaaaagcacaaagagctggggcagaggcaggaagcaggggccctcctggcagctcctctgagtggggagaggttgggcagtgagtgagggacccctaatgcagggactagaagcctcagtttccccattttacccttccacacaatagcctctgtaggttaggctgccccatcccaccctactctgtgtggctgctttctttggtgccctcccctcacccccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttagagtctgaagagtgggcctcgggtgccctctcacatctcctgttggatgctgggggagaagcaataaacctcagccctctggcctccactttcctctcaatttgggctgcaaatatgaagcctgaattttatgaaatccactgtagctgtgacgtgttgtagtttttagatgtttgtaaaatgtttaaaaaaatgttaaaaggaaaaaagtgaaaataacaaaaaagaaaatcaaaattcaccttcgtcatgctgcgtccagtgccccaaccctgtggtcactctccccattttgtaacactgtaccaggtggtgactgtttaactctttggtgtctgtgctcaaaagactgccttctccagtgcccagtgtatgagtgtgtgccctgtgcccttgtccctcactccccacatgctggacgtagccctcttcctcgcacccctgggagggacccatccatctcccttgctctcctggggaaccctaaacccaactctgttgatgtgaaaaatgcagtgaaaaatattgacgaaaaataaaacggaaacaaatcctcaaaataaaaaaaaaaaa

SEQ ID NO: 302973 - DNA, 4146 bp, Homo sapiens
  misc_feature (4039)..(4039): n is a, c, g, or t
  misc_feature (4070)..(4070): n is a, c, g, or t
  misc_feature (4091)..(4091): n is a, c, g, or t
ggcggaggcggggctggagtggtggaaggggggtggcaggtctgcattgccgcttccctggtgccgggagcagtcgccgctgccgcctccgcccgcggccgggacccccgtcctcgcccgggactccttacccggggaacctagaccaggtctccagaggcttgtggaagagaagcaggcgacccttcctgagttatcctggcttagcctcccaatctggctccccttccccttcccattcccctgctccccctgtcccttccccatccacccaactgaactgggtataggtcaaagctcctctccttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcagggcattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatgggtggagttttcagatgggttctgcctaccagttccatagctggagggtcttcgtcctcgtctgcgcctttccttctgtgtttgccattggggctctgaccacgcagcctgagagcccccgtttcttcctagagaatggaaagcatgatgaggcctggatggtgctgaagcaggtccatgataccaacatgcgagccaaaggacatcctgagcgagtgttctcagtaacccacattaagacgattcatcaggaggatgaattgattgagatccagtcggacacagggacctggtaccagcgctggggggtccgggccttgagcctaggggggcaggtttgggggaattttctctcctgttttggtcccgaatatcggcgcatcactctgatgatgatgggtgtgtggttcaccatgtcattcagctactatggcctgaccgtctggtttcctgacatgatccgccatctccaggcagtggactacgcatcccgcaccaaagtgttccccggggagcgcgtagagcatgtaacttttaacttcacgttggagaatcagatccaccgaggcgggcagtacttcaatgacaagttcattgggctgcggctcaagtcagtgtcctttgaggattccctgtttgaagagtgttattttgaggatgtcacatccagcaacacgtttttccgcaactgcacattcatcaacactgtgttctataacactgacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttgctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggaccacagcttttggcttcctgaatgccctgtgtaagctggcagctgtgctggggatcagcatcttcacatccttcgtgggaatcaccaaggctgcacccatcctctttgcctcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccctcactccccactccccgtgtttggtgtcttagctgtgtgtgcgtgtgcgtgtgcatgtgtgtaaaccccgtgggcagggactacagggaaggctccttcatcccagttttgagatgaagctgtactccccatttcccactgcccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttagagtctgaagagtgggcctcgggtgccctctcacatctcctgttggatgctgggggagaagcaataaacctcagccctctggcctccactttcctctcaatttgggctgcaaatatgaagcctgaattttatgaaattagctttctgattcttatttattaatagattaagttctgaggcagctccgcaggactgtgtgtgaatgtgtatgtatacttacatatgtgtgtgcatgtgccatggggcggggggtatcactatactgtcctcaaatataagccaagggtaatttcagcggatgcacacacaaccctgcctcccacagttcctcccctaatctggtttctgtgttgagcctgggatggaggagccctaggccagcctgggataagagtcccacagtctagggagatctgagggcatccgacaaggcccatctccttccctcctcaagaagcagaggcctcctctggagtgagaggctccacccactacagcacaggcgggaatagcacagctgccctcccatgctccctacctgtcccctcacagggaggggagcaggggagggaaagaaaccaggcatctggtcaaaccagcagatcaaaaagcacaaagagctggggcagaggcaggaagcaggggccctcctggcagctcctctgagtggggagaggttgggcagtgagtgagggacccctaatgcagggactagaagcctcagtttccccattttacccttccacacaatagcctctgtaggttaggctgccccatcccaccctactctgtgtggctgctttctttggtgccctcccctcaccccactgtagctgtgacgtgttgtagttctagctatatatccaaaaganttgaaagcaggtattcagaaatttgtacatncatgttcatagcaacattatncaaaatagcttaaaggttatttgaggaaacaacccaaaatgtcccatcaaatagg

SEQ ID NO: 302974 - DNA, 4634 bp, Homo sapiens
ggcggaggcggggctggagtggtggaaggggggtggcaggtctgcattgccgcttccctggtgccgggagcagtcgccgctgccgcctccgcccgcggccgggacccccgtcctcgcccgggactccttacccggggaacctagaccaggtctccagaggcttgtggaagagaagcaggcgacccttcctgagttatcctggcttagcctcccaatctggctccccttccccttcccattcccctgctccccctgtcccttccccatccacccaactgaactgggtataggtcaaagctcctctccttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcagggcattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatgggtggagttttcagatgggttctgcctaccagttccatagctggagggtcttcgtcctcgtctgcgcctttccttctgtgtttgccattggggctctgaccacgcagcctgagagcccccgtttcttcctagagaatggaaagcatgatgaggcctggatggtgctgaagcaggtccatgataccaacatgcgagccaaaggacatcctgagcgagtgttctcagtaacccacattaagacgattcatcaggaggatgaattgattgagatccagtcggacacagggacctggtaccagcgctggggggtccgggccttgagcctaggggggcaggtttgggggaattttctctcctgttttggtcccgaatatcggcgcatcactctgatgatgatgggtgtgtggttcaccatgtcattcagctactatggcctgaccgtctggtttcctgacatgatccgccatctccaggcagtggactacgcatcccgcaccaaagtgttccccggggagcgcgtagagcatgtaacttttaacttcacgttggagaatcagatccaccgaggcgggcagtacttcaatgacaagttcattgggctgcggctcaagtcagtgtcctttgaggattccctgtttgaagagtgttattttgaggatgtcacatccagcaacacgtttttccgcaactgcacattcatcaacactgtgttctataacactgacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttgctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggaccacagcttttggcttcctgaatgccctgtgtaagctggcagctgtgctggggatcagcatcttcacatccttcgtgggaatcaccaaggctgcacccatcctctttgcctcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccctcactccccactccccgtgtttggtgtcttagctgtgtgtgcgtgtgcgtgtgcatgtgtgtaaaccccgtgggcagggactacagggaaggctccttcatcccagttttgagatgaagctgtactccccatttcccactgcccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttagagtctgaagagtgggcctcgggtgccctctcacatctcctgttggatgctgggggagaagcaataaacctcagccctctggcctccactttcctctcaatttgggctgcaaatatgaagcctgaattttatgaaattagctttctgattcttatttattaatagattaagttctgaggcagctccgcaggactgtgtgtgaatgtgtatgtatacttacatatgtgtgtgcatgtgccatggggcggggggtatcactatactgtcctcaaatataagccaagggtaatttcagcggatgcacacacaaccctgcctcccacagttcctcctctggagtgagaggctccacccactacagcacaggcgggaatagcacagctgccctcccatgctccctacctgtcccctcacagggaggggagcaggggagggaaagaaaccaggcatctggtcaaaccagcagatcaaaaagcacaaagagctggggcagaggcaggaagcaggggccctcctggcagctcctctgagtggggagaggttgggcagtgagtgagggacccctaatgcagggactagaagcctcagtttccccattttacccttccacacaatagcctctgtaggttaggctgccccatcccaccctactctgtgtggctgctttctttggtgccctcccctcacccccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttagagtctgaagagtgggcctcgggtgccctctcacatctcctgttggatgctgggggagaagcaataaacctcagccctctggcctccactttcctctcaatttgggctgcaaatatgaagcctgaattttatgaaatccactgtagctgtgacgtgttgtagtttttagatgtttgtaaaatgtttaaaaaaatgttaaaaggaaaaaagtgaaaataacaaaaaagaaaatcaaaattcaccttcgtcatgctgcgtccagtgccccaaccctgtggtcactctccccattttgtaacactgtaccaggtggtgactgtttaactctttggtgtctgtgctcaaaagactgccttctccagtgcccagtgtatgagtgtgtgccctgtgcccttgtccctcactccccacatgctggacgtagccctcttcctcgcacccctgggagggacccatccatctcccttgctctcctggggaaccctaaacccaactctgttgatgtgaaaaatgcagtgaaaaatattgacgaaaaataaaacggaaacaaatcctcaaaataaaaaaaaaaaa

SEQ ID NO: 302975 - DNA, 3255 bp, Homo sapiens
ggcggaggcggggctggagtggtggaaggggggtggcaggtctgcattgccgcttccctggtgccgggagcagtcgccgctgccgcctccgcccgcggccgggacccccgtcctcgcccgggactccttacccggggaacctagaccaggtctccagaggcttgtggaagagaagcaggcgacccttcctgagttatcctggcttagcctcccaatctggctccccttccccttcccattcccctgctccccctgtcccttccccatccacccaactgaactgggtataggtcaaagctcctctccttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcagggcattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatgggtggagttttcagatgggttctgcctaccagttccatagctggagggtcttcgtcctcgtctgcgcctttccttctgtgtttgccattggggctctgaccacgcagcctgagagcccccgtttcttcctagagaatggaaagcatgatgaggcctggatggtgctgaagcaggtccatgataccaacatgcgagccaaaggacatcctgagcgagtgttctcagtaacccacattaagacgattcatcaggaggatgaattgattgagatccagtcggacacagggacctggtaccagcgctggggggtccgggccttgagcctaggggggcaggtttgggggaattttctctcctgttttggtcccgaatatcggcgcatcactctgatgatgatgggtgtgtggttcaccatgtcattcagctactatggcctgaccgtctggtttcctgacatgatccgccatctccaggcagtggactacgcatcccgcaccaaagtgttccccggggagcgcgtagagcatgtaacttttaacttcacgttggagaatcagatccaccgaggcgggcagtacttcaatgacaagttcattgggctgcggctcaagtcagtgtcctttgaggattccctgtttgaagagtgttattttgaggatgtcacatccagcaacacgtttttccgcaactgcacattcatcaacactgtgttctataacactgacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttgctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggaccacagcttttggcttcctgaatgccctgtgtaagctggcagctgtgctggggatcagcatcttcacatccttcgtgggaatcaccaaggctgcacccatcctctttgcctcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccccactgtagctgtgacgtgttgtagtttttagatgtttgtaaaatgtttaaaaaaatgttaaaaggaaaaaagtgaaaataacaaaaaagaaaatcaaaattcaccttcgtcatgctgcgtccagtgccccaaccctgtggtcactctccccattttgtaacactgtaccaggtggtgactgtttaactctttggtgtctgtgctcaaaagactgccttctccagtgcccagtgtatgagtgtgtgccctgtgcccttgtccctcactccccacatgctggacgtagccctcttcctcgcacccctgggagggacccatccatctcccttgctctcctggggaaccctaaacccaactctgttgatgtgaaaaatgcagtgaaaaatattgacgaaaaataaaacggaaacaaatcctcaaaataaaaaaaaaaaa

SEQ ID NO: 302976 - DNA, 2419 bp, Homo sapiens
ggcggaggcggggctggagtggtggaaggggggtggcaggtctgcattgccgcttccctggtgccgggagcagtcgccgctgccgcctccgcccgcggccgggacccccgtcctcgcccgggactccttacccggggaacctagaccaggtctccagaggcttgtggaagagaagcaggcgacccttcctgagttatcctggcttagcctcccaatctggctccccttccccttcccattcccctgctccccctgtcccttccccatccacccaactgaactgggtataggtcaaagctcctctccttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcagggcattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatgggtggagttttcagatgggttctgcctaccagttccatagctggagggtcttcgtcctcgtctgcgcctttccttctgtgtttgccattggggctctgaccacgcagcctgagagcccccgtttcttcctagagaatggaaagcatgatgaggcctggatggtgctgaagcaggtccatgataccaacatgcgagccaaaggacatcctgagcgagtgttctcagtaacccacattaagacgattcatcaggaggatgaattgattgagatccagtcggacacagggacctggtaccagcgctggggggtccgggccttgagcctaggggggcaggtttgggggaattttctctcctgttttggtcccgaatatcggcgcatcactctgatgatgatgggtgtgtggttcaccatgtcattcagctactatggcctgaccgtctggtttcctgacatgatccgccatctccaggcagtggactacgcatcccgcaccaaagtgttccccggggagcgcgtagagcatgtaacttttaacttcacgttggagaatcagatccaccgaggcgggcagtacttcaatgacaagttcattgggctgcggctcaagtcagtgtcctttgaggattccctgtttgaagagtgttattttgaggatgtcacatccagcaacacgtttttccgcaactgcacattcatcaacactgtgttctataacactgacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttggtaagggggagaggctgagtcagatctgatagtagggg

SEQ ID NO: 302977 - DNA, 1951 bp, Homo sapiens
ggcggaggcggggctggagtggtggaaggggggtggcaggtctgcattgccgcttccctggtgccgggagcagtcgccgctgccgcctccgcccgcggccgggacccccgtcctcgcccgggactccttacccggggaacctagaccaggtctccagaggcttgtggaagagaagcaggcgacccttcctgagttatcctggcttagcctcccaatctggctccccttccccttcccattcccctgctccccctgtcccttccccatccacccaactgaactgggtataggtcaaagctcctctccttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcagggcattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatgggtggagttttcagatgggttctgcctaccagttccatagctggagggtcttcgtcctcgtctgcgcctttccttctgtgtttgccattggggctctgaccacgcagcctgagagcccccgtttcttcctagagaatggaaagcatgatgaggcctggatggtgctgaagcaggtccatgataccaacatgcgagccaaaggacatcctgagcgagtgttctcagtaacccacattaagacgattcatcaggaggatgaattgattgagatccagtcggacacagggacctggtaccagcgctggggggtccgggccttgagcctaggggggcaggtttgggggaattttctctcctgttttggtcccgaatatcggcgcatcactctgatgatgatgggtgtgtggttcaccatgtcattcagctactatggcctgaccgtctggtttcctgacacaagcgttctatcagtaaccactgtagttaaacatcgcccagca

SEQ ID NO: 302978 - DNA, 1367 bp, Homo sapiens
aggatcgaggccgggttgaatcggccgaggatgaaattagctttctgattcttatttattaatagattaagttctgaggcagctccgcaggactgtgtgtgaatgtgtatgtatacttacatatgtgtgtgcatgtgccatggggcggggggtatcactatactgtcctcaaatataagccaagggtaatttcagcggatgcacacacaaccctgcctcccacagttcctcctctggagtgagaggctccacccactacagcacaggcgggaatagcacagctgccctcccatgctccctacctgtcccctcacagggaggggagcaggggagggaaagaaaccaggcatctggtcaaaccagcagatcaaaaagcacaaagagctggggcagaggcaggaagcaggggccctcctggcagctcctctgagtggggagaggttgggcagtgagtgagggacccctaatgcagggactagaagcctcagtttccccattttacccttccacacaatagcctctgtaggttaggctgccccatcccaccctactctgtgtggctgctttctttggtgccctcccctcacccccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttagagtctgaagagtgggcctcgggtgccctctcacatctcctgttggatgctgggggagaagcaataaacctcagccctctggcctccactttcctctcaatttgggctgcaaatatgaagcctgaattttatgaaatccactgtagctgtgacgtgttgtagtttttagatgtttgtaaaatgtttaaaaaaatgttaaaaggaaaaaagtgaaaataacaaaaaagaaaatcaaaattcaccttcgtcatgctgcgtccagtgccccaaccctgtggtcactctccccattttgtaacactgtaccaggtggtgactgtttaactctttggtgtctgtgctcaaaagactgccttctccagtgcccagtgtatgagtgtgtgccctgtgcccttgtccctcactccccacatgctggacgtagccctcttcctcgcacccctgggagggacccatccatctcccttgctctcctggggaaccctaaacccaactctgttgatgtgaaaaatgcagtgaaaaatattgacgaaaaataaaacggaaacaaatcctcaaaataaaaaaaaaaaa

SEQ ID NO: 302979 - DNA, 648 bp, Homo sapiens
gcggccgccgagggagacggtgcgcctggagctggtgcttaaggaccccaccgacgagagctgcgtggagttcagttacccggagctgctgctgtgcggagaacaacggaagaagctcattcacacagaagacccatttaatgatgaacatcaggagaggcaagaggtggaaatgttggctaagaagtttgaaatgaaatatggtgggaaaccccgtaaacaccggaaggatcggctacaagatttaattgatataggctttggctatgatgagacagatccatttattgataactcagaggcttatgatgaattagttcccgcttctctaacaacaaaatatggaggcttttatatcaacactggcactctacagtttcgccaagcttcagatactgaagaagatgatattacagacaaccaaaagcacaagccacccaaggtccccaaaataaaagaagatgatattgagatgaagaagcggaagcggaaagaggaaggggaaaaggagaagaagccaaggaaaaaagttcccaaacaactgggagttgtggctctaaattcacacaagtctgaaaataataaataaaaccttttgccgaattcttggccctgaagggccaaattgcctaatagtgagtcgtatta

SEQ ID NO: 302980 - DNA, 630 bp, Homo sapiens
attccatcagaaattcttctaggtgtttttactcaaaggaaatctattttttattcacattaggctttggtaagtactatatgcatcatgaagagattataacttaatttgcagtttgatactttttatgacctgtgatgattattgaatctaaaaatagtactaatttattattcacattactttttaaaaaatactgtttttgccttcaccaaatcatcagttaagtgaccttttaaaaaaatcgtttatttcaacagttgtactatcaattccgtattactttacttattcactacatgtttggctttttaacttcctcttagagattaccaactctactgattttttgttgttgttgactatatctatggttatttttttcccccaaaatatactgcctccagccacacatttcaggctgccaaactttttgatgaagaaggaaggaaaaaattctttacacaggatatgaataatattcttctggagtaagtaattttctttaaaaaaaaaaaccttaagaatgatacattaaaaaatgtaataggcctttgagatactgagtggttggcaagtcttgggcatgagttcttccccttaagccttacagcatgtatgattcacatt

SEQ ID NO: 302981 - DNA, 2057 bp, Homo sapiens
gcggccgccgagggagacggtgcgcctggagctggtgcttaaggaccccaccgacgagagctgcgtggagttcagttacccggagctgctgctgtgcggagaacaacggaagaagctcattcacacagaagacccatttaatgatgaacatcaggagaggcaagaggtggaaatgttggctaagaagtttgaaatgaaatatggtgggaaaccccgtaaacaccggaaggatcggctacaagatttaattgatataggctttggctatgatgagacagatccatttattgataactcagaggcttatgatgaattagttcccgcttctctaacaacaaaatatggaggcttttatatcaacactggcactctacagtttcgccaagcttcagatactgaagaagatgatattacagacaaccaaaagcacaagccacccaaggtccccaaaataaaagaagatgatattgagatgaagaagcggaagcggaaagaggaaggggaaaaggagaagaagccaaggaaaaaagttcccaaacaactgggagttgtggctctaaattcacacaagtctgaaaaaaagaagaaacgttataaagattctctttctctagctgccatgattagaaaattccagaaagagaaggatgcattaaagaaggagtctaaccccaaagtcccagtgaccttgtcaaccccttctctgaataaacccccatgtgctgctgcagcactggggaatgacgtcccggacttaaatctgagcagcggtgatccagaccttcccatttttgttagcacaaatgaacatgagctgtttcaggaagctgaaaatgccctagagatgctagatgattttgacttcgacagattactggatgctgcttctgatggtagccccctatctgagtcggggggtgaaaatggaaccaccacccagccaacctacacttctcaggttatgcccaaagtggtacctacactcccagagggtctacctgtacttcttgaaaaacgtatcgaagaccttcgtgtagctgccaaactttttgatgaagaaggaaggaaaaaattctttacacaggatatgaataatattcttctggacattgagttacagctacaagaactaggccctgtcattcgcagtggtgtctactcccaccttgaagcttttgtgccatgcaataaagaaacactagtaaaacgtctgaagaagttacatctcaatgtccaggatgatcgtttaagagaacctctgcaaaaactgaaactggctgttagcaatgtcatgcctgaacagctatttaaataccaggaggactgccaggctcgtagtcaagctaagtgtgccaaattgcagacagatgaagaacgagaaaaaaatggatctgaagaggatgatgatgagaaaccaggaaaacgtgtcataggaccaagaaagaaattccactgggatgacactatcagaactttgttatgtaaccttgttgagatcaaattgggatgctatgagttagaaccaaataaaagccagtctgctgaagattatcttaagtcttttatggagacagaagtgaagcccctgtggcctaagggctggatgcaggcaagaatgctttttaaggaaagccggagtgttcataatcatcttacttctgctccggcaaagaaaaaggtgattcctgcacctaaacccaaagtaaaggaggtgatggtaaagacccttcctctccattctttccccactatgcttaaggagtgtagtccaaaaaaggaccagaaaactccaacatccctggtggcttcggttagcggtcctccaacgagctccagcacagctgccattgctgcagctagctctagctctgcaccagcccaagaaaccatctgcctcgacgactcactagatgaagacctttctttccattcaccttcactggatcttgtttctgaagctttagcggttatcaacaatgggaacaagggccctccagttggctcaaggataagcatgccaaccacaaagcctcgtccaggactgagagaagaaaaat

SEQ ID NO: 302982 - DNA, 1902 bp, Homo sapiens
atcacacagaagtgtagttttgcttcccttaaaatcttctgtgctctgcctattcattcctccttccctcctaatcactggcacctactggtcttaactgtcttcagagttctaccttttccagaatgtcttatagagaaaatcatatatatgatgaattagttcccgcttctctaacaacaaaatatggaggcttttatatcaacactggcactctacagtttcgccaagcttcagatactgaagaagatgatattacagacaaccaaaagcacaagccacccaaggtccccaaaataaaagaagatgatattgagatgaagaagcggaagcggaaagaggaaggggaaaaggagaagaagccaaggaaaaaagttcccaaacaactgggagttgtggctctaaattcacacaagtctgaaaaaaagaagaaacgttataaagattctctttctctagctgccatgattagaaaattccagaaagagaaggatgcattaaagaaggagtctaaccccaaagtcccagtgaccttgtcaaccccttctctgaataaacccccatgtgctgctgcagcactggggaatgacgtcccggacttaaatctgagcagcggtgatccagaccttcccatttttgttagcacaaatgaacatgagctgtttcaggaagctgaaaatgccctagagatgctagatgattttgacttcgacagattactggatgctgcttctgatggtagccccctatctgagtcggggggtgaaaatggaaccaccacccagccaacctacacttctcaggttatgcccaaagtggtacctacactcccagagggtctacctgtacttcttgaaaaacgtatcgaagaccttcgtgtagctgccaaactttttgatgaagaaggaaggaaaaaattctttacacaggatatgaataatattcttctggacattgagttacagctacaagaactaggccctgtcattcgcagtggtgtctactcccaccttgaagcttttgtgccatgcaataaagaaacactagtaaaacgtctgaagaagttacatctcaatgtccaggatgatcgtttaagagaacctctgcaaaaactgaaactggctgttagcaatgtcatgcctgaacagctatttaaataccaggaggactgccaggctcgtagtcaagctaagtgtgccaaattgcagacagatgaagaacgagaaaaaaatggatctgaagaggatgatgatgagaaaccaggaaaacgtgtcataggaccaagaaagaaattccactgggatgacactatcagaactttgttatgtaaccttgttgagatcaaattgggatgctatgagttagaaccaaataaaagccagtctgctgaagattatcttaagtcttttatggagacagaagtgaagcccctgtggcctaagggctggatgcaggcaagaatgctttttaaggaaagccggagtgttcataatcatcttacttctgctccggcaaagaaaaaggtgattcctgcacctaaacccaaagtaaaggaggtgatggtaaagacccttcctctccattctttccccactatgcttaaggagtgtagtccaaaaaaggaccagaaaactccaacatccctggtggcttcggttagcggtcctccaacgagctccagcacagctgccattgctgcagctagctctagctctgcaccagcccaagaaaccatctgcctcgacgactcactagatgaagacctttctttccattcaccttcactggatcttgtttctgaagctttagcggttatcaacaatgggaacaagggccctccagttggctcaaggataagcatgccaaccacaaagcctcgtccaggactgagagaagaaaaat

SEQ ID NO: 302983 - DNA, 1081 bp, Homo sapiens
attcaagttagatatgacaccagattcttttgtctgctcgtagaagtctgcaacttcaatgctgccaaactttttgatgaagaaggaaggaaaaaattctttacacaggatatgaataatattcttctggacattgagttacagctacaagaactaggccctgtcattcgcagtggtgtctactcccaccttgaagcttttgtgccatgcaataaagaaacactagtaaaacgtctgaagaagttacatctcaatgtccaggatgatcgtttaagagaacctctgcaaaaactgaaactggctgttagcaatgtcatgcctgaacagctatttaaataccaggaggactgccaggctcgtagtcaagctaagtgtgccaaattgcagacagatgaagaacgagaaaaaaatggatctgaagaggatgatgatgagaaaccaggaaaacgtgtcataggaccaagaaagaaattccactgggatgacactatcagaactttgttatgtaaccttgttgagatcaaattgggatgctatgagttagaaccaaataaaagccagtctgctgaagattatcttaagtcttttatggagacagaagtgaagcccctgtggcctaagggctggatgcaggcaagaatgctttttaaggaaagccggagtgttcataatcatcttacttctgctccggcaaagaaaaaggtgattcctgcacctaaacccaaagtaaaggaggtgatggtaaagacccttcctctccattctttccccactatgcttaaggagtgtagtccaaaaaaggaccagaaaactccaacatccctggtggcttcggttagcggtcctccaacgagctccagcacagctgccattgctgcagctagctctagctctgcaccagcccaagaaaccatctgcctcgacgactcactagatgaagacctttctttccattcaccttcactggatcttgtttctgaagctttagcggttatcaacaatgggaacaagggccctccagttggctcaaggataagcatgccaaccacaaagcctcgtccaggactgagagaagaaaaat

SEQ ID NO: 302984 - DNA, 452 bp, Homo sapiens
ggcaaagaaaaaggtgattcctgcacctaaacccaaagtaaaggtaagtactgaaacaaaatatttaattagttatagttggtgaatgttgaaatacattcctaagatgaaaaagatgtatggtatttagcagaggtcagtaggcactataagatagatgttttcaacttcataataatcttagtacttttgtatttgggagaatagattcctgtgtagcagtggggaatatgcatacaccaattgtgaagcttaactttattaatacttggaaatgctaggtaaaatacaacaaatattctttcatagcataggtgagattgaaaaatatgtaagaaaaattcataagaccagaaacaaaaaaggagctgacagtgttaatctgtcgcttacactttggttgcccttggaggcatttggcactttctacccatcactttatggtttctttt

SEQ ID NO: 302985 - DNA, 374 bp, Homo sapiens
tactgtaccattataacttttacttggtaaataagccagtaatagtctactgaaaattaaattactttaaaaaataaaacaattatgttactatctgctataaagaaaataataattgtgttctttaaatttttccagaatgctttttaaggaaagccggagtgttcataatcatcttacttctgctccgtgagtaaatgcagactccagattgcttcatttattcacattatgtgctttagtgaacaaaagtatcatttattaaatgctagttggaataggacttaaaaagatcattttgaccattgactatttagacttcagaacacatttatctattgaaataattgtcagggtactctctaaacacctac

SEQ ID NO: 302986 - DNA, 398 bp, Homo sapiens
tgttttctgacctaaaaggtgaatgttggtgcctttacattataatctgaagtccttatttaccaaactactttataactcctttcaaatttgaagtattatgtggaaaggtagattccgtctttaccctctcttttaacattccattaagcaattcagcaagtatttatggagcatattatataggcagtgttgggttaaaagtttgttttgtaaagtgtttttcatttttagattgcagacagatgaagaacgagaaaaaaatggatctgaagaggatgatgatgagaaaccaggaaaacgtgtcataggaccaagaaagaaattccactgggatgacactatcaggtaagatttaattagttttcacttttaatatataatgcagaagtaagatt

SEQ ID NO: 302987 - DNA, 624 bp, Homo sapiens
ttaaattatgtagatattggaaaattggtatttacatcatagaattatattttcttataaaaacttctctctacaaatgtgggctaataatttactgtttctgggagaaggttatatttctcggataggttaatattaatagctgttacctttcctaagatgtcatttttaacaaaatctatagaatttgtatacattgtctttgggaaagatatagtgtccttggataagtgtttcttgaagtgtggcccaaagacttacttacaccagaatcaccagaatgcttgtttaaaatgcaaattataaggttctaactcagataactgaatcgaaaccggaggtgagagtgctcttgaaccccaaggatctgcagttataacaaacgattgtaatgcacactgacatttgagaaaaaccactgctgatgctggattgctaacatcaaagagtaaagcattgttacttacataaatgatcattcttttatcattttgcaggtccccaaaataaaagaagatgatattgagatgaagaagcggaagcggaaagaggaaggggaaaaggagaagaagccaaggaaaaaagttcccaaacaactggggtacgttaaattaaacctaagaa

SEQ ID NO: 302988 - DNA, 612 bp, Homo sapiens
actggagggacgcactgagcatgtgcagatcagctcggtggtggctgccgcggccggaggcgagggcccggtgctgatgcgaaccgccggctcggcctcagcccgcgcgtggtcggccccccaggccggggcgacagggaaggagccgtagcctccccgtggcccgaggagccggcgcggcggcgcgcactccccggcggccgcggcgccctcggggcccacgatgatggcggagcaggtgaaatgcgcctcggcaggggtcagctctggagcgggctccgggccggtggtgaacgcggagctggaggtgaagaagctgcaggagctggtgcgcaagctggagaagcagaacgagcagctgcggagtcgagcggccagcgcggccgccgccccgcacctgctgctgctgccgccgccgccgcccgccgcgccgccccccgctggcctgcagcctttgggtcctcggagccccccggccgccacggccaccgccgcggcctcagggggcctggggctcgggctggcgctgggcgcggggggcggtggcggcagcggtagtggcagcggcggtggctccagccccgcgttcccgggcaccttctgcctgcctag

SEQ ID NO: 302989 - DNA, 2230 bp, Homo sapiens
agatagcagtcacaaagaactattggtcttttaaaatatagaatttttaatgagaaactttgaataatagagattgaacatgtgagaacagctacctagtgtgtgttgcattattaacccctagtttgtagtgtattctggagtcaagttgacctacatagaagagaaggaactggaagtgcatgtctgtgttctggctccgattgggaaaagctgcttaaccactgttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagact

SEQ ID NO: 302990 - DNA, 2630 bp, Homo sapiens
agcggcgtggtgctcttttccccagtgttttcggagggatgacgggggatggtaggggttggcctctgtctgcgactgttactgttctttcgttttaaacgaacgctggacaggatttgcgtgctcttcctcctcgggtggcatcggaagccgcgcagtgatggatctctctttatagagaggttcgttcttgctgtttgaattttgcagtcgtgtgcccttttgcgttgcattttcattgaaatcttattttcagagactgacttgctttttaaaatggggtgacctcactggctttcccatgaatagtgccaataaagaggacttttcttggagtggaatgaacaggttatacattggctcttcaaagacgttcacctcatcagagaaatccctgactcctttgcagtggtgtagacatgtcctagataacccaactcctgagatggaagcagcgagacgttccctgtgctttagactggagcaagtatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagact

SEQ ID NO: 302991 - DNA, 2349 bp, Homo sapiens
agccacccgaggcgcccttcgtctacttcaagccggcagcaggcttcttcggcgcgggcggtggcgggccggagccggggggcgcggggacgccgccaggggcagctgcagcgccgccctcgccgccccccacgctgctggacgaggtggaattgctggatctggagagcgtagccgcctggcgggacgaggacgactacacctggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagact

SEQ ID NO: 302992 - DNA, 2130 bp, Homo sapiens
agatagcagtcacaaagaactattggtcttttaaaatatagaatttttaatgagaaactttgaataatagagattgaacatgtgagaacagctacctagtgtgtgttgcattattaacccctagtttgtagtgtattctggagtcaagttgacctacatagaagagaaggaactggaagtgcatgtctgtgttctggctccgattgggaaaagctgcttaaccactgttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttt

SEQ ID NO: 302993 - DNA, 2499 bp, Homo sapiens
agccacccgaggcgcccttcgtctacttcaagccggcagcaggcttcttcggcgcgggcggtggcgggccggagccggggggcgcggggacgccgccaggggcagctgcagcgccgccctcgccgccccccacgctgctggacgaggtggaattgctggatctggagagcgtagccgcctggcgggacgaggacgactacacctggttatacattggctcttcaaagacgttcacctcatcagagaaatccctgactcctttgcagtggtgtagacatgtcctagataacccaactcctgagatggaagcagcgagacgttccctgtgctttagactggagcaagctagccgatggcggagtctcttctcttcaactgcctcactggcttttccttatagtcctgttgcaagactcagcccttatagcaatggcattaatactcccagcttctctaaaacctcaaataaagcaatactaacacctgaaaaaacaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagact

SEQ ID NO: 302994 - DNA, 2205 bp, Homo sapiens
acacttgtaatcccagcacttttggaggctgaggcggatggatcacctgagctagccgatggcggagtctcttctcttcaactgcctcactggcttttccttatagtcctgttgcaagactcagcccttatagcaatggcattaatactcccagcttctctaaaacctcaaataaagcaatactaacacctgaaaaaacaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagact

SEQ ID NO: 302995 - DNA, 2382 bp, Homo sapiens
actggagggacgcactgagcatgtgcagatcagctcggtggtggctgccgcggccggaggcgagggcccggtgctgatgcgaaccgccggctcggcctcagcccgcgcgtggtcggccccccaggccggggcgacagggaaggagccgtagcctccccgtggcccgaggagccggcgcggcggcgcgcactccccggcggccgcggcgccctcggggcccacgatgatggcggagcaggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagact

SEQ ID NO: 302996 - DNA, 2176 bp, Homo sapiens
agatagcagtcacaaagaactattggtcttttaaaatatagaatttttaatgagaaactttgaataatagagattgaacatgtgagaacagctacctagtgtgtgttgcattattaacccctagtttgtagtgtattctggagtcaagttgacctacatagaagagaaggaactggaagtgcatgtctgtgttctggctccgattgggaaaagctgcttaaccactgttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtactttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagact

SEQ ID NO: 302997 - DNA, 1416 bp, Homo sapiens
gggcggtacgccccggaattacgggatctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagact

SEQ ID NO: 302998 - DNA, 2176 bp, Homo sapiens
agcggcgtggtgctcttttccccagtgttttcggagggatgacgggggatggtaggggttggcctctgtctgcgactgttactgttctttcgttttaaacgaacgctggacaggatttgcgtgctcttcctcctcgggtggcatcggaagccgcgcagtgatggatctctctttatagagaggttcgttcttgctgtttgaattttgcagtcgtgtgcccttttgcgttgcattttcattgaaatcttattttcagagactgacttgctttttaaaatggggtgacctcactggctttcccatgaatagtgccaataaagaggacttttcttggagtggaatgaacaggttatacattggctcttcaaagacgttcacctcatcagagaaatccctgactcctttgcagtggtgtagacatgtcctagataacccaactcctgagatggaagcagcgagacgttccctgtgctttagactggagcaagtatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattacaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtactttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagact

SEQ ID NO: 302999 - DNA, 1161 bp, Homo sapiens
agcggcgtggtgctcttttccccagtgttttcggagggatgacgggggatggtaggggttggcctctgtctgcgactgttactgttctttcgttttaaacgaacgctggacaggatttgcgtgctcttcctcctcgggtggcatcggaagccgcgcagtgatggatctctctttatagagaggttcgttcttgctgtttgaattttgcagtcgtgtgcccttttgcgttgcattttcattgaaatcttattttcagagactgacttgctttttaaaatggggtgacctcactggctttcccatgaatagtgccaataaagaggacttttcttggagtggaatgaacaggttatacattggctcttcaaagacgttcacctcatcagagaaatccctgactcctttgcagtggtgtagacatgtcctagataacccaactcctgagatggaagcagcgagacgttccctgtgctttagactggagcaagtatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagatttcttcagcctccaaagcctctgtc

SEQ ID NO: 303000 - DNA, 483 bp, Homo sapiens
gcataacatctgtcatttttaacttagtaaaattcttttccagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtagtgagtataattatttgatataattatatattgtataattgtataattttttataatttttaattgtaaggaaaatgtctgttttatttctttgtatttacttgaaagaacactaaacttttttccttgccgtgtaacttatttttttatttcaccattagagttgaatagtatttttactattcaaatagtatatttactattcaacttaccagtgcctgtggtataaattacttaccagtgcctgtggtatcaattaataatagtaaattgttatttgtata

SEQ ID NO: 303001 - DNA, 9421 bp, Homo sapiens
cttattttttatgaatgtcggatagctgcaccagcttggtggggaaagggtttgatgaatagcacaaagacactggctgttccctggaggctgtccctttaaaggagaatcttagtttattctggggggaggggatgcacacattagagtaggaaagagggcttggaataaaatgaaaacactcccccttcatagtcattgtactgaaatgcaaagactgcttcctaagctggagatgctaaccttgggtagctccttctgttctcttcaaggggaattttgtcaggctatggattcatttacaactgttagtcatgtgggcatgtgtgaggaaacagatgccagttttaatgtatttagcccgaagttccaatttgataggagccactgtcagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtggggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaagccgaagaataatgttatttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgctttttttttcctgtaaacatagcccataatggcaaaaacaactaattttaattgaaggtcttgcttgccaatcctgtgttggcttttaccaaatataaaaattcccttattccttggtaatggtgcaaatatttggaaaggcacagcatccaaaccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaagaaatactacaagacacccctgtaatggattggtggcaactgggtggcactgctgatgtgcactgtgtaggggggaacccagtggtggtggggtatctcaaatgcccctagacaagcttcagatgtctgtagctaccaaaaacattttcggttcaagaaaagtgagatgatggtagtactggtttctggtgaaattgaaaaaccccaaatgatgaggatctctttttgccccctctcctttttttgtaaacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaaattcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattgttttaaattggcccactttcaaggcaattttttttgtgtgtctgtaactgagctcctccacccctgtcattcacttccaattttacccaatccaattttagcactcaagttccattgtgttaatttttgcacggtctacacacatcaagtcagcaagcatttgccaccactccctatacttctccctcttttttacacacacacacacacacacacacacaatccatctcttgcttgttcctacctccctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgtttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaaagaaagagtggaacaatagctttgttcatcctaactttctgagatggcttttcaacatttaaaaaaaactagtgtggtaccattcactggcatgatttcttttagaatatgggagtaagatgaggtagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctttagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaaacgtctgtgccaagagacttccccagatagaaacactgggacagtggtttgaacgacttcttttatggttgtccagtttgctatggaaataaaaggcattgattttttaaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccaaaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaactttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagcaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagactttgaaggcattagcgtttctcattacttaggtcaataaccttgagggaatcaatggcttttttgccgctctacctctttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaata

SEQ ID NO: 303002 - DNA, 9080 bp, Homo sapiens
gagagattggttttctttctctcagcatctccacccaaccagcagaaaaccggtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtggggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaagccgaagaataatgttatttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgctttttttttcctgtaaacatagcccataatggcaaaaacaactaattttaattgaaggtcttgcttgccaatcctgtgttggcttttaccaaatataaaaattcccttattccttggtaatggtgcaaatatttggaaaggcacagcatccaaaccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaagaaatactacaagacacccctgtaatggattggtggcaactgggtggcactgctgatgtgcactgtgtaggggggaacccagtggtggtggggtatctcaaatgcccctagacaagcttcagatgtctgtagctaccaaaaacattttcggttcaagaaaagtgagatgatggtagtactggtttctggtgaaattgaaaaaccccaaatgatgaggatctctttttgccccctctcctttttttgtaaacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaaattcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattgttttaaattggcccactttcaaggcaattttttttgtgtgtctgtaactgagctcctccacccctgtcattcacttccaattttacccaatccaattttagcactcaagttccattgtgttaatttttgcacggtctacacacatcaagtcagcaagcatttgccaccactccctatacttctccctcttttttacacacacacacacacacacacacacaatccatctcttgcttgttcctacctccctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgtttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaaagaaagagtggaacaatagctttgttcatcctaactttctgagatggcttttcaacatttaaaaaaaactagtgtggtaccattcactggcatgatttcttttagaatatgggagtaagatgaggtagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctttagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaaacgtctgtgccaagagacttccccagatagaaacactgggacagtggtttgaacgacttcttttatggttgtccagtttgctatggaaataaaaggcattgattttttaaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccaaaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaactttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagcaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagactttgaaggcattagcgtttctcattacttaggtcaataaccttgagggaatcaatggcttttttgccgctctacctctttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaata

SEQ ID NO: 303003 - DNA, 9328 bp, Homo sapiens
gagagattggttttctttctctcagcatctccacccaaccagcagaaaaccggtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtggggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaagccgaagaataatgttatttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgctttttttttcctgtaaacatagcccataatggcaaaaacaactaattttaattgaaggtcttgcttgccaatcctgtgttggcttttaccaaatataaaaattcccttattccttggtaatggtgcaaatatttggaaaggcacagcatccaaaccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaagaaatactacaagacacccctgtaatggattggtggcaactgggtggcactgctgatgtgcactgtgtaggggggaacccagtggtggtggggtatctcaaatgcccctagacaagcttcagatgtctgtagctaccaaaaacattttcggttcaagaaaagtgagatgatggtagtactggtttctggtgaaattgaaaaaccccaaatgatgaggatctctttttgccccctctcctttttttgtaaacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaaattcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattgttttaaattggcccactttcaaggcaattttttttgtgtgtctgtaactgagctcctccacccctgtcattcacttccaattttacccaatccaattttagcactcaagttccattgtgttaatttttgcacggtctacacacatcaagtcagcaagcatttgccaccactccctatacttctccctcttttttacacacacacacacacacacacacacaatccatctcttgcttgttcctacctccctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgtttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaaagaaagagtggaacaatagctttgttcatcctaactttctgagatggcttttcaacatttaaaaaaaactagtgtggtaccattcactggcatgatttcttttagaatatgggagtaagatgaggtagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctttagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaaacgtctgtgccaagagacttccccagatagaaacactgggacagtggtttgaacgacttcttttatggttgtccagtttgctatggaaataaaaggcattgattttttaaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccaaaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaactttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagcaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagactttgaaggcattagcgtttctcattacttaggtcaataaccttgagggaatcaatggcttttttgccgctctacctctttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaataaaaaaaaaaaaaaaaaaaaaaaaaaaaaaaaaaaaaaaaaaaaaaaaaaaaaacaaaaaaaaaaaaaagcaaaaaaaaaaacaaacacaacacaaaaaaagagagagcgagaagaaacccaatgaacgtaaagaaacacggcgacgaaggcggcgggcggggcgtcgcccacgaccccgcccgccgtggcgagcgcgaactacccgcgcacacccagcggggggcacgggacgcacagcgagcgccac

SEQ ID NO: 303004 - DNA, 9089 bp, Homo sapiens
ttttgccttattctatccgattttttccctaagcttctacctgggattttcctttggaaaagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtggggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaagccgaagaataatgttatttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgctttttttttcctgtaaacatagcccataatggcaaaaacaactaattttaattgaaggtcttgcttgccaatcctgtgttggcttttaccaaatataaaaattcccttattccttggtaatggtgcaaatatttggaaaggcacagcatccaaaccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaagaaatactacaagacacccctgtaatggattggtggcaactgggtggcactgctgatgtgcactgtgtaggggggaacccagtggtggtggggtatctcaaatgcccctagacaagcttcagatgtctgtagctaccaaaaacattttcggttcaagaaaagtgagatgatggtagtactggtttctggtgaaattgaaaaaccccaaatgatgaggatctctttttgccccctctcctttttttgtaaacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaaattcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattgttttaaattggcccactttcaaggcaattttttttgtgtgtctgtaactgagctcctccacccctgtcattcacttccaattttacccaatccaattttagcactcaagttccattgtgttaatttttgcacggtctacacacatcaagtcagcaagcatttgccaccactccctatacttctccctcttttttacacacacacacacacacacacacacaatccatctcttgcttgttcctacctccctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgtttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaaagaaagagtggaacaatagctttgttcatcctaactttctgagatggcttttcaacatttaaaaaaaactagtgtggtaccattcactggcatgatttcttttagaatatgggagtaagatgaggtagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctttagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaaacgtctgtgccaagagacttccccagatagaaacactgggacagtggtttgaacgacttcttttatggttgtccagtttgctatggaaataaaaggcattgattttttaaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccaaaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaactttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagcaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagactttgaaggcattagcgtttctcattacttaggtcaataaccttgagggaatcaatggcttttttgccgctctacctctttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaata

SEQ ID NO: 303005 - DNA, 922 bp, Homo sapiens
ggaagtttaggttaactgtcttaaatttccaaagctgtaatcattattttcattctcaaagtgatggccttgtgttttgctcctctcctccagggccagactgagcccaggttgatttcaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcaaccacttctggtgccaggaggagccggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaaccttctctgtggctccaaccccaagactcccaggcacatgggatggatgtccagtgctaccacccaagccccctccttctttgtgtggaatctgcaatagtgggctgactccctccagccccatgccggccctacccgcccttgaagtatagccagccaaggttggagctcagaccgtgtctaggttggggctcggctgtggccctggggtctcctgctcagctcagaagagccttctggagaggacagtcagctgagcacctcccatcctgctcacacgtccttccccataactatggaaatggccctaatttctgtgaaataaagactttttgtatttctggggctgaggctcagcaacagcccctcaggcttc

SEQ ID NO: 303006 - DNA, 1146 bp, Homo sapiens
gtggacaccacgtgatcctggggaggcttttgcctcttccgagggctctggctccagggcctccctgttccaggggctaggtgtgccttcctcaatgctgcttttggctatgagggtgacgggcccagggcttcagggccccagatcgcaccttgccatctggggtgtccgtcctttgtcccccacagcaggctgtgtttgcccattttctcctctgccatgggtggagatggatctgaagttgggtgttgaagcctctgaccaaggctgtatcttgttttgaggccctgcccggtttccagggaccacatctggggccaagaggaagaaccgaactgggactaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcaaccacttctggtgccaggaggagccggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaaccttctctgtggctccaaccccaagactcccaggcacatgggatggatgtccagtgctaccacccaagccccctccttctttgtgtggaatctgcaatagtgggctgactccctccagccccatgccggccctacccgcccttgaagtatagccagccaaggttggagctcagaccgtgtctaggttggggctcggctgtggccctggggtctcctgctcagctcagaagagccttctggagaggacagtcagctgagcacctcccatcctgctcacacgtccttccccataactatggaaatggccctaatttctgtgaaataaagactttttgtatttctggggctgaggctcagcaacagcccctcaggcttc

SEQ ID NO: 303007 - DNA, 681 bp, Homo sapiens
caggctcatggatggatgtcagtgctacacccaagcccctccttctttgtgtggaatctgcaatagtgggctgactccctccagccccatgccggccctacccgcccttgaagtatagccagccaaggttggagccggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaaccttctctgtggctccaaccccaagactcccaggcacatgggatggatgtccagtgctaccacccaagccccctccttctttgtgtggaatctgcaatagtgggctgactccctccagccccatgccggccctacccgcccttgaagtatagccagccaaggttggagctcagaccgtgtctaggttggggctcggctgtggccctggggtctcctgctcagctcagaagagccttctggagaggacagtcagctgagcacctcccatcctgctcacacgtccttccccataactatggaaatggccctaatttctgtgaaataaagactttttgtatttctggggctgaggctcagcaacagcccctcaggcttc

SEQ ID NO: 303008 - DNA, 813 bp, Homo sapiens
ggaagtttaggttaactgtcttaaatttccaaagctgtaatcattattttcattctcaaagtgatggccttgtgttttgctcctctcctccagggccagactgagcccaggttgatttcaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaagggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaaccttctctgtggctccaaccccaagactcccaggcacatgggatggatgtccagtgctaccacccaagccccctccttctttgtgtggaatctgcaatagtgggctgactccctccagccccatgccggccctacccgcccttgaagtatagccagccaaggttggagctcagaccgtgtctaggttggggctcggctgtggccctggggtctcctgctcagctcagaagagccttctggagaggacagtcagctgagcacctcccatcctgctcacacgtccttccccataactatggaaatggccctaatttctgtgaaataaagactttttgtatttctggggctgaggctcagcaacagcccctcaggcttc

SEQ ID NO: 303009 - DNA, 703 bp, Homo sapiens
cgcgcactttcgggtgttgtctggccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttgga

SEQ ID NO: 303010 - DNA, 1340 bp, Homo sapiens
cgcgcactttcgggtgttgtctggccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgatggggcgcctacccttcttcagcaagatgggaacagctgagtctgaaggaagagaaacactgacacagcagctgcctctcccagcagccgccatgagaagattgttacctgcaagcagagtgtccactcaacccgtgctgaggctggcagacagtgctgagtcacttctgggcaggcctgctctgtgggctctaggattcctgctttgccctccctctcaggcacaatgacaactactgctcagtgccagacactgcaccatgtaggcaacacgtggcagtgatgattagtcacaaaatcacatttatattcattctaatgaaactgccattgcaaaattataactgagacagtgaaagaagtctgacctaaccaactccatcttgcttctaacctccaagctgtccttgttcattcctgggactcattttgggaggaacttagttaatagcttacagtttaaaacaaagacaatcacagacctttcccaaaacaaacccccttcttgcctggaaactagactgcctttgtaggattaacaaattagccgaaagattagaaattatggtttaggagtcacgcagctggagatgacaagattctgacactcctccaattgctcctggggataacattactattctaaggcctaacatcagtgcttgagatgttttgtagaccctgcccttgatggatcagctggtactacccagaccgataaactggctcgtcttatcttgtggcccccacccaggagctgactcaatgcaagaagactgttctgactccctatgatttcatctccaacccaaccaagcggcactgtcaactcactggcctccccctacccaccaaattatccttaaaaactcagatccccaaatgctcagggaaactgattatgattaccccaaagcttggagtaataataaaactggcctgtctcccgcac

SEQ ID NO: 303011 - DNA, 2709 bp, Homo sapiens
cgcgcactttcgggtgttgtctggccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatcta

SEQ ID NO: 303012 - DNA, 1539 bp, Homo sapiens
cgcgcactttcgggtgttgtctggccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacactt

SEQ ID NO: 303013 - DNA, 491 bp, Homo sapiens
  misc_feature (15)..(15): n is a, c, g, or t
caccaaactggcccncggtccaatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttgga

SEQ ID NO: 303014 - DNA, 591 bp, Homo sapiens
cacagcggcaaacgctatcaggggtaaagggacgtagtggcttccacactgaggaaaaccccagcagtggtcagacaggcagggtctgcaggagagatgaggtctgggatatcacacctgcgttgacaggatgcctgtgcggcagcgagtagaggaagctggctttccctctaacctgctcgtgccgaattcggcacgagggagccttcccactggaggctgaaagtggcttgtggtattataatgttcagatttcaagaggaaggtgcaggtacacatgagttagagagaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatcta

SEQ ID NO: 303015 - DNA, 2829 bp, Homo sapiens
tgcgcggggaagcgacccccgccccggcctgcgcttggcccggaggtgggcgcggcgccctcgggcaacggacggttgcgaccccggcttcgccctgcagcccccactttctgccgatttcggcagcctctctcccacccatcgccccccggacaaaatatgaagtggttggcggtcagtgaggagtcccgtcgcgacttggacggccacacacgttttgcaggagtttgcatccgagagagagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatcta

SEQ ID NO: 303016 - DNA, 2636 bp, Homo sapiens
atcgccgaccacgcgtcgggagcgacgatagcgcagggaggcagtcaacagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatcta

SEQ ID NO: 303017 - DNA, 3171 bp, Homo sapiens
tgcgcggggaagcgacccccgccccggcctgcgcttggcccggaggtgggcgcggcgccctcgggcaacggacggttgcgaccccggcttcgccctgcagcccccactttctgccgatttcggcagcctctctcccacccatcgccccccggacaaaatatgaagtggttggcggtcagtgaggagtcccgtcgcgacttggacggccacacacgttttgcaggagtttgcatccgagagagaggcaggcagagcgtgggattgagaaggctgaggctgctagagatgccagctatggaaaaccagtcatttcccaccgaaaggcacaagtgcggtctgcgggcgctgcacgggtctgcccgaaacctcgaccccacgtccaccccggccgcccgcgcccgaggctttacaggctcccgaaacgggtgcattttcatctgcggtgtctggaccctagagttgatcctgtaggcgaccccaaagtgctcctggctctcttccctctccgcagttgcaccctgaggctttttcaaatttcaaaatttttctttttttccttttttttttttaagaagataaaatactgctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatcta

SEQ ID NO: 303018 - DNA, 2715 bp, Homo sapiens
agcgggtgggcgcccggcgcccgctccggtcgctcggcccgcgcggtggtgggcgctctccggcgggcgcgctctgagcgtggcgcggggcgggtgcggcgtggcgggggtcaagtgcgtgtgagttaggctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatcta

SEQ ID NO: 303019 - DNA, 2619 bp, Homo sapiens
tatggagtttgccgtaatggaatgatatcgaaagctttgattgatagtccttgcggagcaatcggactgatggtggatgcattggcatgtgtccctgtccaattatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatcta

SEQ ID NO: 303020 - DNA, 2484 bp, Homo sapiens
cgcgcactttcgggtgttgtctggccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattatggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatcta

SEQ ID NO: 303021 - DNA, 2433 bp, Homo sapiens
aaggcatgcttcttttagatcataattgggatacaactagagccttgatttttttttttattttcctttcgtttttcatgcctgttgactgagtgtatcttatttccatagattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatcta

SEQ ID NO: 303022 - DNA, 3167 bp, Homo sapiens
cgcgcactttcgggtgttgtctggccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatctattttagtttgtgggtgtttttgaaatgaaaatatatggcacactttcattctgaagtgcattaacattctaataaggtgatgtaaagcaagatgacattggtgtaatgttagagttgcagaagtttccattccaaaataaaatggaaaccatagttacagatattacaatgcagccctgtaattttgagctgtagtaaaaggattggtaatctgggaagtagaatttttacaaaatcttttacaaaaatagtcataaaaggttttgttgacatttaagactactactgatctaaaggcaaggtcctacttcttaaattttcagaacatttttatgacttcttattatgtatttattaccactcattattatagcatgttactttttgcaaacattttaaacaaaaaatatttctgtttggtacactgtgaagagagaaaagtactgttctgtattttc

SEQ ID NO: 303023 - DNA, 1056 bp, Homo sapiens
  misc_feature (24)..(24): n is a, c, g, or t
gatctagaggaccctgacaccagnacactggtatggtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatcta

SEQ ID NO: 303024 - DNA, 955 bp, Homo sapiens
actcacttctagcagcgcgagcggcagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatcta

SEQ ID NO: 303025 - DNA, 908 bp, Homo sapiens
actctagaggacccccgacgagttgtccgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatcta

SEQ ID NO: 303026 - DNA, 335 bp, Homo sapiens
accccatctcaattttaaaaaagaaaaaaattataaaactaaaattctagcttatattagggtaacccacaaatctttaaaaaggaaaaaaactttgattctgatagacatacgaacagttaatctaatttttatatttaaatttgtgcttcgggatgcagagatctaaagccctaaaatgagaagtatgggaaattctggccagtttttagtcagaagtaaagtattttttcctgtttaaaaactatggtacatttcagatatgctgaaagccagaaaataatataaaagtgctcacatattcactgcctggcataaaaatgaaaaaaaaaaaa

SEQ ID NO: 303027 - DNA, 2014 bp, Homo sapiens
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303028 - DNA, 1989 bp, Homo sapiens
ggccccaggagggaggaggagggaattcgctaagagggactggggcctgagacggaatgggggcgggccccgggcggggtgggggcccctgggctcccagggtgggagctggctccgaggctggctggctccgcaggtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303029 - DNA, 1957 bp, Homo sapiens
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303030 - DNA, 1943 bp, Homo sapiens
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaaccaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303031 - DNA, 1914 bp, Homo sapiens
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggcgacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303032 - DNA, 2421 bp, Homo sapiens
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagtggactgaaggcttttgcagagcaaaagccaggaagttttgtcacaaacttccaccaaggccaggaagcagagtctattccgtgccaaaattaagggaagaaaagagggaaaatctaggcaaatggaatttaatatctcaaaaagattatcttgccgagccatagtcacatagcaagctgaggcagcggaggcttggggctacttctcttgttcttggttctgggtttaccttctttgggccttatttgccacatctgtaagaggagtgggctggaccgcgctccaccatgccgtattcactaagtgagcagatagaaccatagaaagcatgctcactctcaaatcgtgctcatggaaagaacgacgtgttcaggactcatgcctccctttctcaacatacccccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303033 - DNA, 1490 bp, Homo sapiens
ggccccaggagggaggaggagggaattcgctaagagggactggggcctgagacggaatgggggcgggccccgggcggggtgggggcccctgggctcccagggtgggagctggctccgaggctggctggctccgcaggtccgctgacgtcgccgcccagatggcctccaggctgaccctgctgaccctcctgctgctgctgctggctggggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303034 - DNA, 1204 bp, Homo sapiens
acgggcatcacgatctaaacgggcacacggacactcagaacataccacagaccaggagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303035 - DNA, 2016 bp, Homo sapiens
ggccccaggagggaggaggagggaattcgctaagagggactggggcctgagacggaatgggggcgggccccgggcggggtgggggcccctgggctcccagggtgggagctggctccgaggctggctggctccgcaggtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgagcaaccctcccacctcttccctctagccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303036 - DNA, 1943 bp, Homo sapiens
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttagtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303037 - DNA, 1488 bp, Homo sapiens
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303038 - DNA, 1014 bp, Homo sapiens
  misc_feature (2)..(3): n is a, c, g, or t
cnngagtgccaaatgttgtcttccacttggcactcaggtagatagcattgaggaggacaaggcgggtatcggagggcagactgtctagcagccggctgatcttgttgttggtgttcttggccacccaggtgttgatgagcttaaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303039 - DNA, 1634 bp, Homo sapiens
  misc_feature (260)..(260): n is a, c, g, or t
gccctgcacttcttacatacttttgtctggtcaccagttgaaagtccttcttcttttttttttctctttttgagatggagtctcgctctgtcaccaggctggagtgcagtggcatgatctcggctcactgcagcctccacctcccgggttcaagcaattctcctgcctcagcctcctgagtagctgggattacaggcacgtgccaccacccagctaatttttgtatttttagtagaggtggggtttcatcatggtggccnggatggtctcaatctcttgacctcatgatccgcccacctcggcctcccaaagtgctgggattacaggtgtgagccaccgtgcatgaccaaaagtccttctaatagcaaagtggaaaggtaggctgtgaacaatcttgaatgccatactaagatttgtacttattctcataggcagtgaagagccatcaatagtttttacagaggctgacctgataactctggcggttcaatgtgcatgctatatactatatgcacaacacattaggaaggaagggaacagcgctcagagaaatcaaatcacttgcccatattacatagctcgtcagtggtggagtcagggtataatcagaaactcatgctccttcctctacctctccccagcacagagttggatcagcactgttcacccagctggtatccccatttcatggtaaagcctggaagcttaggtctgactgatgcttgttgaaatacagactgtgggagcagactgcaggacagcattgtgacagagggtggggccaggagagagatgcggtaggaagactgttaaggtgcatctcttattttctgtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303040 - DNA, 870 bp, Homo sapiens
tatattttaggctggaaacaggattctcaagtttcttcatgcatctctactatattgaatggcaaaatgtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303041 - DNA, 869 bp, Homo sapiens
caaactcaggggcgagctgttaactcaggccgagctgcagggtgaactcagaggcgagctgctaactgtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303042 - DNA, 1762 bp, Homo sapiens
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccaggttactcagtgaccatcaggataagatcaggacgcgacgtaccactccagtccagttacactcacgaatacagtgtatgacca

SEQ ID NO: 303043 - DNA, 1690 bp, Homo sapiens
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303044 - DNA, 1488 bp, Homo sapiens
  misc_feature (1433)..(1433): n is a, c, g, or t
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggnaatccttcgatttttcttatcagtccaacatccggggtcagtccaacatccgggt

SEQ ID NO: 303045 - DNA, 1673 bp, Homo sapiens
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303046 - DNA, 595 bp, Homo sapiens
gcggccgcctactactactaaattcgcggccgcgtcgacaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303047 - DNA, 1344 bp, Homo sapiens
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaagtttgtgggacaaaaacttgatactacaggcaattggaagagagttagttacatcggaaaggccagtacctggcacgtagtcttgcagatcaagttacaggcggatcatgcctttgtgtatctatcaaaatga

SEQ ID NO: 303048 - DNA, 1302 bp, Homo sapiens
  misc_feature (1194)..(1194): n is a, c, g, or t
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtgcgcctgggtgcagaagtgcgcntgggtgcagaagtgcgcctgggtgcagaagtgcgcctgggtgcagaagtgcgccgggtgcagaagtgcgcctgggtgcagaagtgcgcctgggtgcagaagcgcctgg

SEQ ID NO: 303049 - DNA, 1149 bp, Homo sapiens
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaagtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaacaaaaatggccttgttgggctcaacggaggagcttctcggcctgtttcct

SEQ ID NO: 303050 - DNA, 1705 bp, Homo sapiens
caggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagtggactgaaggcttttgcagagcaaaagccaggaagttttgtcacaaacttccaccaaggccaggaagcagagtctattccgtgccaaaattaagggaagaaaagagggaaaatctaggcaaatggaatttaatatctcaaaaagattatcttgccgagccatagtcacatagcaagctgaggcagcggaggcttggggctacttctcttgttcttggttctgggtttaccttctttgggccttatttgccacatctgtaagaggagtgggctggaccgcgctccaccatgccgtattcactaagtgagcagatagaaccatagaaagcatgctcactctcaaatcgtgctcatggaaagaacgacgtgttcaggactcatgcctccctttctcaacatacccccagacctggccataagggacacctttgtgaatgcctctcggaccctgtacagcagcagccccagagtcctaagcaacaacagtgacgccaacttggagctcatcaacacctgggtggccattgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatca

SEQ ID NO: 303051 - DNA, 1671 bp, Homo sapiens
gctaggcccagagagcctggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatccctacgaccaccgcccctcacatcaccttctcatgggtccctctcccactccaaagcccccagtggctcccagatgagccacaatgctgtaacaagccatcaacgtccagggtggcctggccagcctcattcccctttcccccaccccacaccccacttccagcctgatgcctccttactccagcctgtcacccccttagggacatcgcggtggaggaagatctcagcagcactcccctattgaaagacctgctggagctcacaaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatggacccgtggggcttgtaatctgtctctttctactatttacatctgatttaaataaaccattccatctgaaaggggcaaaaaaaaaaa

SEQ ID NO: 303052 - DNA, 740 bp, Homo sapiens
gctaggcccagagagcctggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagaggtgagtgccggggtgtggccgcccccgggccttctcactgctcctcataggccttagggacaaaggccagtccttctgcagtccctgatcaacatgagaggctggggttgagtcagaacccaaatactcagaaatgcaacctctcagaactgctttaacgaaactttgagctgtggctcaccaccctcagacacaaatgagaacactgaggctccaagagtgggagtgacttgcccacggtcacacaacgagtgaccggcagtgtctggagaggaatgcaggtgtcctgggtcccaggctggggccctttgcttcacatggtgatcagcaatgactttccatcttctgcgcaaacagaattcacagaatctggcttgttcttccgctaatcagggcttgcctcaaatgtcacctcctccaagaagccttcctgacagcccctacctcattgctgtctgaccctttgccctatttcccttttctgcctggttcttatattacaggaa

SEQ ID NO: 303053 - DNA, 1426 bp, Homo sapiens
gctaggcccagagagcctggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaaggacatcgcggtggaggaagatctcagcagcactcccctattgaaagacctgctggagctcacaaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatggacccgtggggcttgtaatctgtctctttctactatttacatctgatttaaataaaccattccatctgaaaggggcaaaaaaaaaaa

SEQ ID NO: 303054 - DNA, 1354 bp, Homo sapiens
ggggagagtctcgcccagccagtcccaggctgagttcacctctcacttcctccagccaccctgcgtctcgtctcagcctgggactggctgggcgagactctccacctgctccctgggaccatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaaggacatcgcggtggaggaagatctcagcagcactcccctattgaaagacctgctggagctcacaaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatggacccgtggggcttgtaatctgtctctttctactatttacatctgatttaaataaaccattccatctgaaaggggcaaaaaaaaaaa

SEQ ID NO: 303055 - DNA, 1062 bp, Homo sapiens
ctggagtcagggagacctgggttcaattcccagctcctccactaaaaaatggggtggcctcagagaagtcgcttattctccccaagcctcagtttctacatctgtaaaatgggagactaaagctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatccctacgaccaccgcccctcacatcaccttctcatgggtccctctcccactccaaagcccccagtggctcccagatgagccacaatgctgtaacaagccatcaacgtccagggtggcctggccagcctcattcccctttcccccaccccacaccccacttccagcctgatgcctccttactccagcctgtcacccccttagggacatcgcggtggaggaagatctcagcagcactcccctattgaaagacctgctggagctcacaaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatggacccgtggggcttgtaatctgtctctttctactatttacatctgatttaaataaaccattccatctgaaaggggcaaaaaaaaaaa

SEQ ID NO: 303056 - DNA, 325 bp, Homo sapiens
acatcgaggagaagagaggcttcaccagccactttgtaagacagactcctagtccttcacccaacaacctctgaacttccacccagctgacctctgaaccttgccctctgacctctgaacctccaattctctgatctcttaacttctatctcagtggttctcaacaggaccgattttgcccatttgacattaccctgggagattctgattattgcatcttggggcaggtctactccacatctagtgggtagaatccagggtgctgctaaacaccccactgtgcacatgacagccctgtccccagtaaagaactgtccggccccag

SEQ ID NO: 303057 - DNA, 459 bp, Homo sapiens
aagcctttgttgaatgaataagtgaatgagtgagataaaagcagctttctatataaatccagattctggcatattgtaaaacccaaatataagccttcttagaagtgaccagctcagcgaacttcctcgctttccctcctccctctacagaagaagacccggacctcatctgcctttccccatcactagaacggggctgagggctctgaggcgtggctctgctgcctctcctctcaccagcatggcatcccttctcttcctctgcagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatccctacgaccaccgccc

SEQ ID NO: 303058 - DNA, 388 bp, Homo sapiens
gtccctggactttgggactcattctgctcgacttgatccccgctctgcccattgatcacatacacacgtttacacctggcagaagaggaagaggaggcatgaaggaatggcctcttcagaatggagaaaagccttccccatgagaacatgcctaagacagactgctgaagaaggcggcaagtggaacagcgctgaatcagcctggtcatcccagtcaagcctccagacatgtaagcaccctcctctgatctgcagagctgcctggcccaaatactgttgaccactcttgagtaagccccaccaagatcagctgagaacagtagaactgaccagatgactctaacctcatgaataaatccaagtgtttttttatttgcctctgaaattt

SEQ ID NO: 303059 - DNA, 534 bp, Homo sapiens
  misc_feature (531)..(532): n is a, c, g, or t
  misc_feature (534)..(534): n is a, c, g, or t
gatgaatctgaccacagatcctttataccctggaccacaaaagggaggagaagaacttgaacagaaaatgcagttaggggtttggattactgccttgtgactaataaataggactagacactttcatccccacatataagacagtcagctcacagagaaaaatgacaaggtgggtctgcaaacaacggaagcactggcgcaccaaaacttgatctacagagccatctgaaactataaacaaatatgctgatgaatattaagaagatgaaagaaagaaaccaaaggtttaaaaatatgatgctgaaaacaatgaaatgtctctaggtaattaaacagtatggcaggtaatctaatttaaaactaaaacccagctcaaactaagaaaacatattcccaccctctgcttgatttgctttctttcaagggcctttaaagcaaaacactaaccatgaagagttttacttttcccaggaaatgaaatattttctaacacagaacagcaaataaaatactttttctaacacaaaaaannan

SEQ ID NO: 303060 - DNA, 4397 bp, Homo sapiens
  misc_feature (4395)..(4395): n is a, c, g, or t
ggagggggtccttgccaggcctggggcggccgggggcggtcctgggctcccctccgtcccgcctccaggcctcggggcctggctggccgacgtggcgttggcggcgctgcgcgcgggagggcagggcaggagggacagaggcgggggcgggccggaaagtttgtccggcggcagcggcgttggggactccggcgggggatgcgcgcccggcccctcagcgcccccagcacgccgccgagtcccgctcgccatgggccactccccacctgtcctgcctttgtgtgcctctgtgtctttgctgggtggcctgacctttggttatgaactggcagtcatatcaggtgccctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgtgggcatcctgctctcctatgccctcaactatgcactggctggtaccccctggggatggaggcacatgttcggctgggccactgcacctgctgtcctgcaatccctcagcctcctcttcctccctgctggtacagatgagactgcaacacacaaggacctcatcccactccagggaggtgaggcccccaagctgggcccggggaggccacggtactcctttctggacctcttcagggcacgcgataacatgcgaggccggaccacagtgggcctggggctggtgctcttccagcaactaacagggcagcccaacgtgctgtgctatgcctccaccatcttcagctccgttggtttccatgggggatcctcagccgtgctggcctctgtggggcttggcgcagtgaaggtggcagctaccctgaccgccatggggctggtggaccgtgcaggccgcagggctctgttgctagctggctgtgccctcatggccctgtccgtcagtggcataggcctcgtcagctttgccgtgcccatggactcaggcccaagctgtctggctgtgcccaatgccaccgggcagacaggcctccctggagactctggcctgctgcaggactcctctctacctcccattccaaggaccaatgaggaccaaagggagccaatcttgtccactgctaagaaaaccaagccccatcccagatctggagacccctcagcccctcctcggctggccctgagctctgccctccctgggccccctctgcccgctcgggggcatgcactgctgcgctggaccgcactgctgtgcctgatggtctttgtcagtgccttctcctttgggtttgggccagtgacctggcttgtcctcagcgagatctaccctgtggagatacgaggaagagccttcgccttctgcaacagcttcaactgggcggccaacctcttcatcagcctctccttcctcgatctcattggcaccatcggcttgtcctggaccttcctgctctacggactgaccgctgtcctcggcctgggcttcatctatttatttgttcctgaaacaaaaggccagtcgttggcagagatagaccagcagttccagaagagacggttcaccctgagctttggccacaggcagaactccactggcatcccgtacagccgcatcgagatctctgcggcctcctgaggaatccgtctgcctggaaattctggaactgtggctttggcagaccatctccagcatcctgcttcctaggccccagagcacaagttccagctggtcttttgggagtggcccctgcccccaaaggtggtctgcttttgctggggtaaaaaggatgaaagtctgagaatgcccaactcttcattttgagtctcaggccctgaaggttcctgaggatctagcttcatgcctcagtttccccattgacttgcacatctctgcagtatttataagaagaatattctatgaagtctttgttgcaccatggacttttctcaaagaatctcaagggtaccaatcctggcaggaagtctctcccgatatcacccctaaatccaaatgaggatatcatcttttctaatctcttttttcaactggctgggacattttcggaagggggaagtctctttttttactcttatcattttttttttttgaggtggagtctcattctgttgcccaggctggcctgatcttggctcactgcaacctccacctcctgagttcaagcgattcttgtgcctcagcctcctaagcagctgggactacaggcgcatgcaaccatacccagctaatttatttttagcagagatggggtttcactgtgttggccaggctggtcgtgaactcctgagctcaagtgatccacccacctcagcctcccagagtgctaggattacaggccttttgactcttttatctgagttttattgacccctctaattctcttacccagaatatttatccttcaccagcaactctgactctttgacgggaggcctcagttctagtccttggtctgctggtgtcattgctgtaggaatgaccacgggcctcagtttccccatttgtataatgggaagcctgtaccaggtcattcttaagatttctcctgactccagtgagctggaattctaaatgctggtctaggagctgtctccaggatggtgcaggatggctttgcggaaaggagatgggtttggaggccaacaaacctgcttgtcaatattgcctttgcctcttggcagcccttgaacttgagtaaataacaactccctgaacctcagtttcctcatctgcagaatggggataattatgtcccaggggtatatttagaccctgtttcctttcaggagggtccccagctggtccagggcctgggaaatttctacttatcctcattacccaggtccctcctttggaccctgtaaagggtcagggtgaatcagatgggggactgagcaagtagctatgactgcagatcatgtaaggaagggactgacaagaagctcccagatgctggggagaatgaagagctaaaatagatcctaggtgctggatgctttgtcatccatgcgtgcacatatgggtgctggcagagcccccaaggactctggcctctcgagttctcctatcttctccattctagatgcttcccttgtatccagtgatgtgctggagctggctttgccaagcttgtgagagctggttgctacattttcaggatttttacaagttggtaaacacagccattataaaaaattaaatgatttaaatttataattaagtaaattacattaaaacaaaaaaattatactcaaaattcattacttaattttactacctgttactattatctgtgcttttgaggctatttctacatagtaactcttatggagacctaggggagacaccgcgcatctcttcctgattccccactcaatgacatcatgttagtctttggttgcttaactggctgtggggagtgtttttgtatcacaaagattagagaggactacacatcagggcttgatttattgtttgttgattttctagacttcagaacatgctggataaaatgtcagtaatgcaaattaaactttaaagtatgtcttgtttgtagccaatacatggtgtatagcaccaaaaaatggagggattattcttccagtagttgaacactgtcatccgtttcagctgacagctgctcaaatcatttaagaaggagttctgacattcattttcattgttttacttttgtcttcctcactagtgtaaacaaaaatttcaaccagcattcatgccgaacctatacccattcttcagtgcctagctgtacagttatcagggatttttatttgtagtctaattttgtcaaatcatggccaaatcgcagtgatagttgactttggatacaaggtttggcaaaaaaaaaaatattaacaaaatattctgtaagaatcaattgtctatatggaatttaggataaagaatatttacaataaagaatatttacaataaagagtttattattatttgtaagttgtgtgcaacaaacataccctttatctctgtaaaatttatacacacaaaaattaacaaaagattctgtaagaattaattggctatatggaatttaggatagaatatttacaataaagagtatttacaataaagagtttgttattatttgtaaaaaaaanaa

SEQ ID NO: 303061 - DNA, 4366 bp, Homo sapiens
ggagggggtccttgccaggcctggggcggccgggggcggtcctgggctcccctccgtcccgcctccaggcctcggggcctggctggccgacgtggcgttggcggcgctgcgcgcgggagggcagggcaggagggacagaggcgggggcgggccggaaagtttgtccggcggcagcggcgttggggactccggcgggggatgcgcgcccggcccctcagcgcccccagcacgccgccgagtcccgctcgccatgggccactccccacctgtcctgcctttgtgtgcctctgtgtctttgctgggtggcctgacctttggttatgaactggcagtcatatcaggtgccctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgtgggcatcctgctctcctatgccctcaactatgcactggctggtaccccctggggatggaggcacatgttcggctgggccactgcacctgctgtcctgcaatccctcagcctcctcttcctccctgctggtacagatgagactgcaacacacaaggacctcatcccactccagggaggtgaggcccccaagctgggcccggggaggccacggtactcctttctggacctcttcagggcacgcgataacatgcgaggccggaccacagtgggcctggggctggtgctcttccagcaactaacagggcagcccaacgtgctgtgctatgcctccaccatcttcagctccgttggtttccatgggggatcctcagccgtgctggcctctgtggggcttggcgcagtgaaggtggcagctaccctgaccgccatggggctggtggaccgtgcaggccgcagggctctgttgctagctggctgtgccctcatggccctgtccgtcagtggcataggcctcgtcagctttgccgtgcccatggactcaggcccaagctgtctggctgtgcccaatgccaccgggcagacaggcctccctggagactctggcctgctgcaggactcctctctacctcccattccaaggaccaatgaggaccaaagggagccaatcttgtccactgctaagaaaaccaagccccatcccagatctggagacccctcagcccctcctcggctggccctgagctctgccctccctgggccccctctgcccgctcgggggcatgcactgctgcgctggaccgcactgctgtgcctgatggtctttgtcagtgccttctcctttgggtttgggccagtgacctggcttgtcctcagcgagatctaccctgtggagatacgaggaagagccttcgccttctgcaacagcttcaactgggcggccaacctcttcatcagcctctccttcctcgatctcattggcaccatcggcttgtcctggaccttcctgctctacggactgaccgctgtcctcggcctgggcttcatctatttatttgttcctgaaacaaaaggccagtcgttggcagagatagaccagcagttccagaagagacggttcaccctgagctttggccacaggcagaactccactggcatcccgtacagccgcatcgagatctctgcggcctcctgaggaatccgtctgcctggaaattctggaactgtggctttggcagaccatctccagcatcctgcttcctaggccccagagcacaagttccagctggtcttttgggagtggcccctgcccccaaaggtggtctgcttttgctggggtaaaaaggatgaaagtctgagaatgcccaactcttcattttgagtctcaggccctgaaggttcctgaggatctagcttcatgcctcagtttccccattgacttgcacatctctgcagtatttataagaagaatattctatgaagtctttgttgcaccatggacttttctcaaagaatctcaagggtaccaatcctggcaggaagtctctcccgatatcacccctaaatccaaatgaggatatcatcttttctaatctcttttttcaactggctgggacattttcggaagggggaagtctctttttttactcttatcattttttttttttgaggtggagtctcattctgttgcccaggctggcctgatcttggctcactgcaacctccacctcctgagttcaagcgattcttgtgcctcagcctcctaagcagctgggactacaggcgcatgcaaccatacccagctaatttatttttagcagagatggggtttcactgtgttggccaggctggtcgtgaactcctgagctcaagtgatccacccacctcagcctcccagagtgctaggattacaggccttttgactcttttatctgagttttattgacccctctaattctcttacccagaatatttatccttcaccagcaactctgactctttgacgggaggcctcagttctagtccttggtctgctggtgtcattgctgtaggaatgaccacgggcctcagtttccccatttgtataatgggaagcctgtaccaggtcattcttaagatttctcctgactccagtgagctggaattctaaatgctggtctaggagctgtctccaggatggtgcaggatggctttgcggaaaggagatgggtttggaggccaacaaacctgcttgtcaatattgcctttgcctcttggcagcccttgaacttgagtaaataacaactccctgaacctcagtttcctcatctgcagaatggggataattatgtcccaggggtatatttagaccctgtttcctttcaggagggtccccagctggtccagggcctgggaaatttctacttatcctcattacccaggtccctcctttggaccctgtaaagggtcagggtgaatcagatgggggactgagcaagtagctatgactgcagatcatgtaaggaagggactgacaagaagctcccagatgctggggagaatgaagagctaaaatagatcctaggtgctggatgctttgtcatccatgcgtgcacatatgggtgctggcagagcccccaaggactctggcctctcgagttctcctatcttctccattctagatgcttcccttgtatccagtgatgtgctggagctggctttgccaagcttgtgagagctggttgctacattttcaggatttttacaagttggtaaacacagccattataaaaaattaaatgatttaaatttataattaagtaaattacattaaaacaaaaaaattatactcaaaattcattacttaattttactacctgttactattatctgtgcttttgaggctatttctacatagtaactcttatggagacctaggggagacaccgcgcatctcttcctgattccccactcaatgacatcatgttagtctttggttgcttaactggctgtggggagtgtttttgtatcacaaagattagagaggactacacatcagggcttgatttattgtttgttgattttctagacttcagaacatgctggataaaatgtcagtaatgcaaattaaactttaaagtatgtcttgtttgtagccaatacatggtgtatagcaccaaaaaatggagggattattcttccagtagttgaacactgtcatccgtttcagctgacagctgctcaaatcatttaagaaggagttctgacattcattttcattgttttacttttgtcttcctcactagtgtaaacaaaaatttcaaccagcattcatgccgaacctatacccattcttcagtgcctagctgtacagttatcagggatttttatttgtagtctaattttgtcaaatcatggccaaatcgcagtgatagttgactttggatacaaggtttggcaaaaaaaaaaatattaacaaaatattctgtaagaatcaattgtctatatggaatttaggataaagaatatttacaataaagaatatttacaataaagagtttattattatttgtaagttgtgtgcaacaaacataccctttatctctgtaaaatttatacacacaaaaattaacaaaagattctgtaagaattaattggctatatggaatttaggatagaatatttacaataaagagtatttacaata

SEQ ID NO: 303062 - DNA, 970 bp, Homo sapiens
ggagggggtccttgccaggcctggggcggccgggggcggtcctgggctcccctccgtcccgcctccaggcctcggggcctggctggccgacgtggcgttggcggcgctgcgcgcgggagggcagggcaggagggacagaggcgggggcgggccggaaagtttgtccggcggcagcggcgttggggactccggcgggggatgcgcgcccggcccctcagcgcccccagcacgccgccgagtcccgctcgccatgggtaagtcccgatcgggcgctgcctgctggaagcccgaccccttcccagggtgtagacaccgcccccacgctcccctaagagtgcgcgccccctggctcccccagggccgccccggccggataccgcctctcgggtggccagcccgagactgcaggcctgcggcgggggctgggacggggctcggtcgcgcttccttccatcttcctttctgccccggaaaagtggcccctcacttgctgcagcgcccactcgggcccaggcactctcccgggcgccctgatccgacagccccaggcaagtgcagctgttcctggtctgcagatgaagaaatggaggctccgaaagaagcaaagcagttcatcgattcgctgagcgcggttgtgccccaggcgctgttgtgggcctggggacgctgtcgcgaacgaaactgcgaacaaaacagacgaaccccctcctctggacgtgattctgcagagaggggacagagaaggagattctaacacagcattggggtgggacgcgtggggaatggctttgttgccactcgggactagggctctatttttctctctgcattcagaagcctcgaaggatcagtcgttgattcttgagtgagcacctactacgtgccagacattgatataggggttagagcttcagcaatgaacaaaatagacaataaacctctctctcatggaggtggcattctgattgag

SEQ ID NO: 303063 - DNA, 4186 bp, Homo sapiens
  misc_feature (4184)..(4184): n is a, c, g, or t
ctcactatagggctcactcactatagggctcgagcggccgcccgccactccccacctgtcctgcctttgtgtgcctctgtgtctttgctgggtggcctgacctttggttatgaactggcagtcatatcaggtgccctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgtgggcatcctgctctcctatgccctcaactatgcactggctggtaccccctggggatggaggcacatgttcggctgggccactgcacctgctgtcctgcaatccctcagcctcctcttcctccctgctggtacagatgagactgcaacacacaaggacctcatcccactccagggaggtgaggcccccaagctgggcccggggaggccacggtactcctttctggacctcttcagggcacgcgataacatgcgaggccggaccacagtgggcctggggctggtgctcttccagcaactaacagggcagcccaacgtgctgtgctatgcctccaccatcttcagctccgttggtttccatgggggatcctcagccgtgctggcctctgtggggcttggcgcagtgaaggtggcagctaccctgaccgccatggggctggtggaccgtgcaggccgcagggctctgttgctagctggctgtgccctcatggccctgtccgtcagtggcataggcctcgtcagctttgccgtgcccatggactcaggcccaagctgtctggctgtgcccaatgccaccgggcagacaggcctccctggagactctggcctgctgcaggactcctctctacctcccattccaaggaccaatgaggaccaaagggagccaatcttgtccactgctaagaaaaccaagccccatcccagatctggagacccctcagcccctcctcggctggccctgagctctgccctccctgggccccctctgcccgctcgggggcatgcactgctgcgctggaccgcactgctgtgcctgatggtctttgtcagtgccttctcctttgggtttgggccagtgacctggcttgtcctcagcgagatctaccctgtggagatacgaggaagagccttcgccttctgcaacagcttcaactgggcggccaacctcttcatcagcctctccttcctcgatctcattggcaccatcggcttgtcctggaccttcctgctctacggactgaccgctgtcctcggcctgggcttcatctatttatttgttcctgaaacaaaaggccagtcgttggcagagatagaccagcagttccagaagagacggttcaccctgagctttggccacaggcagaactccactggcatcccgtacagccgcatcgagatctctgcggcctcctgaggaatccgtctgcctggaaattctggaactgtggctttggcagaccatctccagcatcctgcttcctaggccccagagcacaagttccagctggtcttttgggagtggcccctgcccccaaaggtggtctgcttttgctggggtaaaaaggatgaaagtctgagaatgcccaactcttcattttgagtctcaggccctgaaggttcctgaggatctagcttcatgcctcagtttccccattgacttgcacatctctgcagtatttataagaagaatattctatgaagtctttgttgcaccatggacttttctcaaagaatctcaagggtaccaatcctggcaggaagtctctcccgatatcacccctaaatccaaatgaggatatcatcttttctaatctcttttttcaactggctgggacattttcggaagggggaagtctctttttttactcttatcattttttttttttgaggtggagtctcattctgttgcccaggctggcctgatcttggctcactgcaacctccacctcctgagttcaagcgattcttgtgcctcagcctcctaagcagctgggactacaggcgcatgcaaccatacccagctaatttatttttagcagagatggggtttcactgtgttggccaggctggtcgtgaactcctgagctcaagtgatccacccacctcagcctcccagagtgctaggattacaggccttttgactcttttatctgagttttattgacccctctaattctcttacccagaatatttatccttcaccagcaactctgactctttgacgggaggcctcagttctagtccttggtctgctggtgtcattgctgtaggaatgaccacgggcctcagtttccccatttgtataatgggaagcctgtaccaggtcattcttaagatttctcctgactccagtgagctggaattctaaatgctggtctaggagctgtctccaggatggtgcaggatggctttgcggaaaggagatgggtttggaggccaacaaacctgcttgtcaatattgcctttgcctcttggcagcccttgaacttgagtaaataacaactccctgaacctcagtttcctcatctgcagaatggggataattatgtcccaggggtatatttagaccctgtttcctttcaggagggtccccagctggtccagggcctgggaaatttctacttatcctcattacccaggtccctcctttggaccctgtaaagggtcagggtgaatcagatgggggactgagcaagtagctatgactgcagatcatgtaaggaagggactgacaagaagctcccagatgctggggagaatgaagagctaaaatagatcctaggtgctggatgctttgtcatccatgcgtgcacatatgggtgctggcagagcccccaaggactctggcctctcgagttctcctatcttctccattctagatgcttcccttgtatccagtgatgtgctggagctggctttgccaagcttgtgagagctggttgctacattttcaggatttttacaagttggtaaacacagccattataaaaaattaaatgatttaaatttataattaagtaaattacattaaaacaaaaaaattatactcaaaattcattacttaattttactacctgttactattatctgtgcttttgaggctatttctacatagtaactcttatggagacctaggggagacaccgcgcatctcttcctgattccccactcaatgacatcatgttagtctttggttgcttaactggctgtggggagtgtttttgtatcacaaagattagagaggactacacatcagggcttgatttattgtttgttgattttctagacttcagaacatgctggataaaatgtcagtaatgcaaattaaactttaaagtatgtcttgtttgtagccaatacatggtgtatagcaccaaaaaatggagggattattcttccagtagttgaacactgtcatccgtttcagctgacagctgctcaaatcatttaagaaggagttctgacattcattttcattgttttacttttgtcttcctcactagtgtaaacaaaaatttcaaccagcattcatgccgaacctatacccattcttcagtgcctagctgtacagttatcagggatttttatttgtagtctaattttgtcaaatcatggccaaatcgcagtgatagttgactttggatacaaggtttggcaaaaaaaaaaatattaacaaaatattctgtaagaatcaattgtctatatggaatttaggataaagaatatttacaataaagaatatttacaataaagagtttattattatttgtaagttgtgtgcaacaaacataccctttatctctgtaaaatttatacacacaaaaattaacaaaagattctgtaagaattaattggctatatggaatttaggatagaatatttacaataaagagtatttacaataaagagtttgttattatttgtaaaaaaaanaa

SEQ ID NO: 303064 - DNA, 4381 bp, Homo sapiens
  misc_feature (4379)..(4379): n is a, c, g, or t
ggagggggtccttgccaggcctggggcggccgggggcggtcctgggctcccctccgtcccgcctccaggcctcggggcctggctggccgacgtggcgttggcggcgctgcgcgcgggagggcagggcaggagggacagaggcgggggcgggccggaaagtttgtccggcggcagcggcgttggggactccggcgggggatgcgcgcccggcccctcagcgcccccagcacgccgccgagtcccgctcgccatgggccactccccacctgtcctgcctttgtgtgcctctgtgtctttgctgggtggcctgacctttggttatgaactggcagtcatatcaggtgccctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgtgggcatcctgctctcctatgccctcaactatgcactggctggtaccccctggggatggaggcacatgttcggctgggccactgcacctgctgtcctgcaatccctcagcctcctcttcctccctgctggtacagatgagactgcaacacacaaggacctcatcccactccagggaggtgaggcccccaagctgggcccggggaggccacggtactcctttctggacctcttcagggcacgcgataacatgcgaggccggaccacagtgggcctggggctggtgctcttccagcaactaacagggcagcccaacgtgctgtgctatgcctccaccatcttcagctccgttggtttccatgggggatcctcagccgtgctggcctctgtggggcttggcgcagtgaaggtggcagctaccctgaccgccatggggctggtggaccgtgcaggccgcagggctctgttgctagctggctgtgccctcatggccctgtccgtcagtggcataggcctcgtcagctttgccgtgcccatggactcaggcccaagctgtctggctgtgcccaatgccaccgggcagacaggcctccctggagactctggcctgctgcaggactcctctctacctcccattccaaggaccaatgaggaccaaagggagccaatcttgtccactgctaagaaaaccaagccccatcccagatctggagacccctcagcccctcctcggctggccctgagctctgccctccctgggccccctctgcccgctcgggggcatgcactgctgcgctggaccgcactgctgtgcctgatggtctttgtcagtgccttctcctttgggtttgggccagtgacctggcttgtcctcagcgagatctaccctgtggagatacgaggaagagccttcgccttctgcaacagcttcaactgggcggccaacctcttcatcagcctctccttcctcgatctcattggcaccatcggcttgtcctggaccttcctgctctacggactgaccgctgtcctcggcctgggcttcatctatttatttgttcctgaaacaaaaggccagtcgttggcagagatagaccagcagttccagaagagacggttcaccctgagctttggccacaggcagaactccactggcatcccgtacagccgcatcgagatctctgcggcctcctgaggaatccgtctgcctggaaattctggaactgtggctttggcagaccatctccagcatcctgcttcctaggccccagagcacaagttccagctggtcttttgggagtggcccctgcccccaaaggtggtctgcttttgctggggtaaaaaggatgaaagtctgagaatgcccaactcttcattttgagtctcaggccctgaaggttcctgaggatctagcttcatgcctcagtttccccattgacttgcacatctctgcagtatttataagaagaatattctatgaagtctttgttgcaccatggacttttctcaaagaatctcaagggtaccaatcctggcaggaagtctctcccgatatcacccctaaatccaaatgaggatatcatcttttctaatctcttttttcaactggctgggacattttcggaagggggaagtctctttttttactcttatcattttttttttttgaggtggagtctcattctgttgcccaggctggcctgatcttggctcactgcaacctccacctcctgagttcaagcgattcttgtgcctcagcctcctaagcagctgggactacaggcgcatgcaaccatacccagctaatttatttttagcagagatggggtttcactgtgttggccaggctggtcgtgaactcctgagctcaagtgatccacccacctcagcctcccagagtgctaggattacaggccttttgactcttttatctgagttttattgacccctctaattctcttacccagaatatttatccttcaccagcaactctgactctttgacgggaggcctcagttctagtccttggtctgctggtgtcattgctgtaggaatgaccacgggcctcagtttccccatttgtataatgggaagcctgtaccaggtcattcttaagatttctcctgactccagtgagctggaattctaaatgctggtctaggagctgtctccaggatggtgcaggatggctttgcggaaaggagatgggtttggaggccaacaaacctgcttgtcaatattgcctttgcctcttggcagcccttgaacttgagtaaataacaactccctgaacctcagtttcctcatctgcagaatggggataattatgtcccaggggtatatttagaccctgtttcctttcaggagggtccccagctggtccagggcctgggaaatttctacttatcctcattacccaggtccctcctttggaccctgtaaagggtcagggtgaatcagatgggggactgagcaagtagctatgactgcagatcatgtaaggaagggactgacaagaagctcccagatgctggggagaatgaagagctaaaatagatcctaggtgctggatgctttgtcatccatgcgtgcacatatgggtgctggcagagcccccaaggactctggcctctcgagttctcctatcttctccattctagatgcttcccttgtatccagtgatgtgctggagctggctttgccaagcttgtgagagctggttgctacattttcaggatttttacaagttggtaaacacagccattataaaaaattaaatgatttaaatttataattaagtaaattacattaaaacaaaaaaattatactcaaaattcattacttaattttactacctgttactattatctgtgcttttgaggctatttctacatagtaactcttatggagacctaggggagacaccgcgcatctcttcctgattccccactcaatgacatcatgttagtctttggttgcttaactggctgtggggagtgtttttgtatcacaaagattagagaggactacacatcagggcttgatttattgtttgttgattttctagacttcagaacatgctggataaaatgtcagtaatgcaaattaaactttaaagtatgtcttgtttgtagccaatacatggtgtatagcaccaaaaaatggagggattattcttccagtagttgaacactgtcatccgtttcagctgacagctgctcaaatcatttaagaaggagttctgacattcattttcattgttttacttttgtcttcctcactagtgtaaacaaaaatttcaaccagcattcatgccgaacctatacccattcttcagtgcctagctgtacagttatcagggatttttatttgtagtctaattttgtcaaatcatggccaaatcgcagtgatagttgactttggatacaaggtttggcaaaaaaaaaaatattaacaaaatattctgtaagaatcaattgtctatatggaatttaggataaagaatatttacaataaagagtttattattatttgtaagttgtgtgcaacaaacataccctttatctctgtaaaatttatacacacaaaaattaacaaaagattctgtaagaattaattggctatatggaatttaggatagaatatttacaataaagagtatttacaataaagagtttgttattatttgtaaaaaaaanaa

SEQ ID NO: 303065 - DNA, 3085 bp, Homo sapiens
gctcacttccagccgcctgtcacagtactgggagtaagaggtgacctatttatttttagaagggggcagtgataataacccagctcctagcttcattcaagggaggcaggcgctttggaagtttgtaaacaccgactttctgagtaagggaggagcactttttttccaaaaaggaaagaacgtctctactgggtttttttcctcctgatattcagcattagagtagaaaagaaactattgtttggccacattagccgtggttagcaggtgctgcagcctttgccactgttattatttttaaagggcagaaatgcctgaaggtgaagactttggaccaggcaaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagataaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatgaaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagta

SEQ ID NO: 303066 - DNA, 808 bp, Homo sapiens
  misc_feature (725)..(725): n is a, c, g, or t
  misc_feature (727)..(727): n is a, c, g, or t
gctcacttccagccgcctgtcacagtactgggagtaagaggtgacctatttatttttagaagggggcagtgataataacccagctcctagcttcattcaagggaggcaggcgctttggaagtttgtaaacaccgactttctgagtaagggaggagcactttttttccaaaaaggaaagaacgtctctactgggtttttttcctcctgatattcagcattagagtagaaaagaaactattgtttggccacattagccgtggttagcaggtgctgcagcctttgccactgttattatttttaaagggcagaaatgcctgaaggtgaagactttggaccaggcaaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctggagcagataaagaaacaagtcccaagatgncngtgaattagacttttcggttcttgtgtcttaggattagctcacggttgctgccaagagtttttgggttggaacagagttta

SEQ ID NO: 303067 - DNA, 782 bp, Homo sapiens
gcctgtgccccgcggtgcgcgccccgctccgggacctgccgccaccgccgccccgccctcggcggcacccacacccaggcgcgcccgcgcgcgcgcccggccccgtccctgcctggaagcacagctgaagatggcgagcccggcgcctccggagcacgccgaggagggatgcccggctcctgccgccgaggagcaggcgccgccgtcgccgccaccgccccaggcatcccccgcagagcggcagcagcaggaggaggaagcgcaggaagctggggcggcggagggcgcggggttgcaggtggaggaggccgcgggccgggcggcggccgcggtaacctggctgctcggggagccggtgctgtggctgggctgccgcgccgacgagctgctgagctggaagaggccgctgcggagcctgctcggcttcgtcgctgccaacctgctgttctggtagacactcaccgcaactttcctccggacgcacgtccctgtgaaacacacgggaatgctcagcccctgagcaacaggtttgtctctccaaaaagcgctcttcagaaaggccagggaaatgtctgtctccttcgttgaaagtggtgtcctgtcatccgttaccacgctattgagggcggagaaaaaccttctttgtttgctaagtgtcctcataacaaacatgacctacacagtgcagaataatcagactccggtaacagataccttgttacaggacagagatttctgaaccttaaagttgagaaataaataaattgcacaaaaaaaaaaac

SEQ ID NO: 303068 - DNA, 3274 bp, Homo sapiens
gcctgtgccccgcggtgcgcgccccgctccgggacctgccgccaccgccgccccgccctcggcggcacccacacccaggcgcgcccgcgcgcgcgcccggccccgtccctgcctggaagcacagctgaagatggcgagcccggcgcctccggagcacgccgaggagggatgcccggctcctgccgccgaggagcaggcgccgccgtcgccgccaccgccccaggcatcccccgcagagcggcagcagcaggaggaggaagcgcaggaagctggggcggcggagggcgcggggttgcaggtggaggaggccgcgggccgggcggcggccgcggtaacctggctgctcggggagccggtgctgtggctgggctgccgcgccgacgagctgctgagctggaagaggccgctgcggagcctgctcggcttcgtcgctgccaacctgctgttctggttccttgcattgactccatggagagtatatcacctgatttccgtcatgatacttgggcgtgttattatgcaaataataaaggatatggttttgtctagaacaagaggtgcacagttgtggagaagcctcagtgaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagataaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatgaaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagta

SEQ ID NO: 303069 - DNA, 3271 bp, Homo sapiens
gcctgtgccccgcggtgcgcgccccgctccgggacctgccgccaccgccgccccgccctcggcggcacccacacccaggcgcgcccgcgcgcgcgcccggccccgtccctgcctggaagcacagctgaagatggcgagcccggcgcctccggagcacgccgaggagggatgcccggctcctgccgccgaggagcaggcgccgccgtcgccgccaccgccccaggcatcccccgcagagcggcagcagcaggaggaggaagcgcaggaagctggggcggcggagggcgcggggttgcaggtggaggaggccgcgggccgggcggcggccgcggtaacctggctgctcggggagccggtgctgtggctgggctgccgcgccgacgagctgctgagctggaagaggccgctgcggagcctgctcggcttcgtcgctgccaacctgctgttctggttccttgcattgactccatggagagtatatcacctgatttccgtcatgatacttgggcgtgttattatgcaaataataaaggatatggttttgtctagaacaagaggtgcacagttgtggagaagcctcagtgaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagataaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatgaaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactacctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagta

SEQ ID NO: 303070 - DNA, 3180 bp, Homo sapiens
gcctgtgccccgcggtgcgcgccccgctccgggacctgccgccaccgccgccccgccctcggcggcacccacacccaggcgcgcccgcgcgcgcgcccggccccgtccctgcctggaagcacagctgaagatggcgagcccggcgcctccggagcacgccgaggagggatgcccggctcctgccgccgaggagcaggcgccgccgtcgccgccaccgccccaggcatcccccgcagagcggcagcagcaggaggaggaagcgcaggaagctggggcggcggagggcgcggggttgcaggtggaggaggccgcgggccgggcggcggccgcggtaacctggctgctcggggagccggtgctgtggctgggctgccgcgccgacgagctgctgagctggaagaggccgctgcggagcctgctcggcttcgtcgctgccaacctgctgttctggttccttgcattgactccatggagagtatatcacctgatttccgtcatgatacttgggcgtgttattatgcaaataataaaggatatggttttgtctagaacaagaggtgcacagttgtggagaagcctcagtgaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagataaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatgaaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatcattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagta

SEQ ID NO: 303071 - DNA, 2362 bp, Homo sapiens
gcctgtgccccgcggtgcgcgccccgctccgggacctgccgccaccgccgccccgccctcggcggcacccacacccaggcgcgcccgcgcgcgcgcccggccccgtccctgcctggaagcacagctgaagatggcgagcccggcgcctccggagcacgccgaggagggatgcccggctcctgccgccgaggagcaggcgccgccgtcgccgccaccgccccaggcatcccccgcagagcggcagcagcaggaggaggaagcgcaggaagctggggcggcggagggcgcggggttgcaggtggaggaggccgcgggccgggcggcggccgcggtaacctggctgctcggggagccggtgctgtggctgggctgccgcgccgacgagctgctgagctggaagaggccgctgcggagcctgctcggcttcgtcgctgccaacctgctgttctggttccttgcattgactccatggagagtatatcacctgatttccgtcatgatacttgggcgtgttattatgcaaataataaaggatatggttttgtctagaacaagaggtgcacagttgtggagaagcctcagtgaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagataaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaatttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagtgtagacttaggctaatggccagaagctggccattgatggcactctatctgccgggggggattaccataaagacaagtgggttcacttgcctgggttgtttacgattcaggtagtgcatcgctagtggaaggtgtgggcagcatagcggctagtaccatctttttgcggtcctatgcttctt

SEQ ID NO: 303072 - DNA, 1648 bp, Homo sapiens
ctccccaggatgaggaattgcccaaaaaattttctccaataacttgtatccatccattgtatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatgaaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagta

SEQ ID NO: 303073 - DNA, 3328 bp, Homo sapiens
gcctgtgccccgcggtgcgcgccccgctccgggacctgccgccaccgccgccccgccctcggcggcacccacacccaggcgcgcccgcgcgcgcgcccggccccgtccctgcctggaagcacagctgaagatggcgagcccggcgcctccggagcacgccgaggagggatgcccggctcctgccgccgaggagcaggcgccgccgtcgccgccaccgccccaggcatcccccgcagagcggcagcagcaggaggaggaagcgcaggaagctggggcggcggagggcgcggggttgcaggtggaggaggccgcgggccgggcggcggccgcggtaacctggctgctcggggagccggtgctgtggctgggctgccgcgccgacgagctgctgagctggaagaggccgctgcggagcctgctcggcttcgtcgctgccaacctgctgttctggttccttgcattgactccatggagagtatatcacctgatttccgtcatgatacttgggcgtgttattatgcaaataataaaggatatggttttgtctagaacaagaggtgcacagttgtggagaagcctcagtgaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagataaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatgaaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagta

SEQ ID NO: 303074 - DNA, 3393 bp, Homo sapiens
gcctgtgccccgcggtgcgcgccccgctccgggacctgccgccaccgccgccccgccctcggcggcacccacacccaggcgcgcccgcgcgcgcgcccggccccgtccctgcctggaagcacagctgaagatggcgagcccggcgcctccggagcacgccgaggagggatgcccggctcctgccgccgaggagcaggcgccgccgtcgccgccaccgccccaggcatcccccgcagagcggcagcagcaggaggaggaagcgcaggaagctggggcggcggagggcgcggggttgcaggtggaggaggccgcgggccgggcggcggccgcggtaacctggctgctcggggagccggtgctgtggctgggctgccgcgccgacgagctgctgagctggaagaggccgctgcggagcctgctcggcttcgtcgctgccaacctgctgttctggttccttgcattgactccatggagagtatatcacctgatttccgtcatgatacttgggcgtgttattatgcaaataataaaggatatggttttgtctagaacaagaggtgcacagttgtggagaagcctcagtgaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagataaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatgaaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagtaaaaaaaaacaattaacttggccggcggttttaccaccgccgtgacttggaccctggcggtaaccc

SEQ ID NO: 303075 - DNA, 3272 bp, Homo sapiens
gcctgtgccccgcggtgcgcgccccgctccgggacctgccgccaccgccgccccgccctcggcggcacccacacccaggcgcgcccgcgcgcgcgcccggccccgtccctgcctggaagcacagctgaagatggcgagcccggcgcctccggagcacgccgaggagggatgcccggctcctgccgccgaggagcaggcgccgccgtcgccgccaccgccccaggcatcccccgcagagcggcagcagcaggaggaggaagcgcaggaagctggggcggcggagggcgcggggttgcaggtggaggaggccgcgggccgggcggcggccgcggtaacctggctgctcggggagccggtgctgtggctgggctgccgcgccgacgagctgctgagctggaagaggccgctgcggagcctgctcggcttcgtcgctgccaacctgctgttctggttccttgcattgactccatggagagtatatcacctgatttccgtcatgatacttgggcgtgttattatgcaaataataaaggatatggttttgtctagaacaagaggtgcacagttgtggagaagcctcagtgaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagataaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatgaaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagta

SEQ ID NO: 303076 - DNA, 1213 bp, Homo sapiens
gcctgtgccccgcggtgcgcgccccgctccgggacctgccgccaccgccgccccgccctcggcggcacccacacccaggcgcgcccgcgcgcgcgcccggccccgtccctgcctggaagcacagctgaagatggcgagcccggcgcctccggagcacgccgaggagggatgcccggctcctgccgccgaggagcaggcgccgccgtcgccgccaccgccccaggcatcccccgcagagcggcagcagcaggaggaggaagcgcaggaagctggggcggcggagggcgcggggttgcaggtggaggaggccgcgggccgggcggcggccgcggtaacctggctgctcggggagccggtgctgtggctgggctgccgcgccgacgagctgctgagctggaagaggccgctgcggagcctgctcggcttcgtcgctgccaacctgctgttctggtagacactcaccgcaactttcctccggacgcacgtccctgtgagcagttgtcgttctccgtgtgcggatccagcctcagatgcgaggtggtcggccgaccctcaggcacctgcacctacaggtgttcccatcgtgcttgaaaacttcgcccctgctttctaaaactctgaggtcttgacctgctcgcccaagcttgccggagcaaacgtgcttgaacgtgtcttggttcttgcggccccagcaggcatatctggaccagattaggtacccgttcaaaacggtgccgcattcatcagtcacctgagatgggccctgaatgatttgttttttccttcccctggaacgttaggtttactgtgtttactccctgatgagaaaacgggaggcaaacaagcaggtggagtatgcccagcacccacccccgggtgtgcacagtgtggaaaacaggcatatttttaggtgaagtacagggagaacacacgggaatgctcagcccctgagcaacaggtttgtctctccaaaaagcgctcttcagaaaggccagggaaatgtctgtctccttcgttgaaagtggtgtcctgtcatccgttaccacgctattgagggcggagaaaaaccttctttgtttgctaagtgtcctcataacaaacatgacctacacagtgcagaataatcagactccggtaacagataccttgttacaggacagagatttctgaaccttaaagttgagaaataaataaattgcacaaaaaaaaaaac

SEQ ID NO: 303077 - DNA, 395 bp, Homo sapiens
tattaatcagaattccctacagaaacagatccaataggatgcatattgcagagagagatttatttgaaggaattctgattaatataccctttcaaggaacagctttggaagattaagataattgtctgcttctggaacaaaagacaggtttgttgctgttcagtttaataaagagagtgtcaccttctggggcaaaggctgagcatgttggcttgcagttcactgttcaagactgggctttcctaaacttggtgtacctgggcggtaaaaccaatcacatgtgcagcatccacctggactgtccccatgggacttggaagggacaggggaaccgaagggaatatgaagcccaggctactggctgtgctgtgaaaaataaagccctttctctctga

SEQ ID NO: 303078 - DNA, 803 bp, Homo sapiens
gggcggggagggaaaggctcgcggccagtagatgcaggagggaggagggcctagaggggctccgggctggcggcctctgtgaggaaggggaaggatatggaaccaagatcctttaaatcctgatgaactcatccgtaaagcagatgcccaaaggatgatacaaggcaatttacttctatagaagggtgcgccctcacagatggagcaatgagatggatttcaccgtgttaggatggcctccatctcctgacttcatgatcttcccgcctcggcctcctgggattacaggtgtgagccaccgcatctggccagaagttaagtttaaaagtagaagacaaagaattgaacatactgacattgattcttcgaagagaaatttagaactcatatctaacaccagcctccaattgattgagccaattccttcaaataaatctctctctgcaatatgcatcctattggatctgtttctgtagggaattctgattaatataccctttcaaggaacagctttggaagattaagataattgtctgcttctggaacaaaagacaggtttgttgctgttcagtttaataaagagagtgtcaccttctggggcaaaggctgagcatgttggcttgcagttcactgttcaagactgggctttcctaaacttggtgtacctgggcggtaaaaccaatcacatgtgcagcatccacctggactgtccccatgggacttggaagggacaggggaaccgaagggaatatgaagcccaggctactggctgtgctgtgaaaaataaagccctttctctctga

SEQ ID NO: 303079 - DNA, 638 bp, Homo sapiens
gggcggggagggaaaggctcgcggccagtagatgcaggagggaggagggcctagaggggctccgggctggcggcctctgtgaggaaggggaaggatatggaaccaagatcctttaaatcctgatgaactcatccgtaaagcagatgcccaaaggatgatacaaggcaatttacttctatagaagggtgcgccctcacagatggagcaatgagatggatttcaccgtgttaggatggcctccatctcctgacttcatgatcttcccgcctcggcctcctgggattacaggtgtgagccaccgcatctggccagaagttaagtttaaaagtagaagacaaagaattgaacatactgacattgattcttcgaagagaaatttagaactcatatctaacaccagcctccaattgattgagccaattccttcaaataaatctctctctgcaatatgcatcctattggatctgtttctgtagggaattctgattaatataccctttcaaggaacagctttggaagattaagataattgtctgcttctggaacaaaagacaggtttgttgctgttcagtttaataaagagagatgcggccggcctgtgtactctcacaccacgctctaccttctacacttcttca

SEQ ID NO: 303080 - DNA, 935 bp, Homo sapiens
agtgggtgggggcggagaacggcgggtcagagagaaggcagcccggtccccctcagtggaagggagtggcgatgatagtaagcttactgtgacataactcccggagccgcagcacgagccttgtgaaccttggaagcccgttttccgcgcagtcactaactcgcttagtcaccctgtgtaaaagttattctgggatgacacctgcctgggaagtctcacctttccccccacctcctcctgtctgcgtattgttctgtagcaccccgtgcgcaccttgattgtagcgcttaagcaaggcaatttacttctatagaagggtgcgccctcacagatggagcaatgagatggatttcaccgtgttaggatggcctccatctcctgacttcatgatcttcccgcctcggcctcctgggattacaggtgtgagccaccgcatctggccagaagttaagtttaaaagtagaagacaaagaattgaacatactgacattgattcttcgaagagaaatttagaactcatatctaacaccagcctccaattgattgagccaattccttcaaataaatctctctctgcaatatgcatcctattggatctgtttctgtagggaattctgattaatataccctttcaaggaacagctttggaagattaagataattgtctgcttctggaacaaaagacaggtttgttgctgttcagtttaataaagagagtgtcaccttctggggcaaaggctgagcatgttggcttgcagttcactgttcaagactgggctttcctaaacttggtgtacctgggcggtaaaaccaatcacatgtgcagcatccacctggactgtccccatgggacttggaagggacaggggaaccgaagggaatatgaagcccaggctactggctgtgctgtgaaaaataaagccctttctctctga

SEQ ID NO: 303081 - DNA, 879 bp, Homo sapiens
gggcggggagggaaaggctcgcggccagtagatgcaggagggaggagggcctagaggggctccgggctggcggcctctgtgaggaaggggaaggatatggaaccaagatcctttaaatcctgatgaactcatccgtaaagcagatgcccaaaggatgatatagtgttggccgggcgcagtggctcatgcctataatcccagcactttgggaggctgaggctggcggatcacctgagcaaggcaatttacttctatagaagggtgcgccctcacagatggagcaatgagatggatttcaccgtgttaggatggcctccatctcctgacttcatgatcttcccgcctcggcctcctgggattacaggtgtgagccaccgcatctggccagaagttaagtttaaaagtagaagacaaagaattgaacatactgacattgattcttcgaagagaaatttagaactcatatctaacaccagcctccaattgattgagccaattccttcaaataaatctctctctgcaatatgcatcctattggatctgtttctgtagggaattctgattaatataccctttcaaggaacagctttggaagattaagataattgtctgcttctggaacaaaagacaggtttgttgctgttcagtttaataaagagagtgtcaccttctggggcaaaggctgagcatgttggcttgcagttcactgttcaagactgggctttcctaaacttggtgtacctgggcggtaaaaccaatcacatgtgcagcatccacctggactgtccccatgggacttggaagggacaggggaaccgaagggaatatgaagcccaggctactggctgtgctgtgaaaaataaagccctttctctctga

SEQ ID NO: 303082 - DNA, 717 bp, Homo sapiens
agtgggtgggggcggagaacggcgggtcagagagaaggcagcccggtccccctcagtggaagggagtggcgatgatagtaagcttactgtgacataactcccggagccgcagcacgagccttgtgaaccttggaagcccgttttccgcgcagtcactaactcgcttagtcaccctgtgtaaaagttattctgggatgacacctgcctgggaagtctcacctttccccccacctcctcctgtctgcgtattgttctgtagcaccccgtgcgcaccttgattgtagcgcttaagcaaggcaatttacttctatagaagggtgcgccctcacagatggagcaatggtgagcacacacctggacaagggaggcgaaggggtttttattcctgacgcttgtggcacctgctgctgtgtccttcccctgttggctaaggttagacggcacaggctaaactaattctgattgactaatttaaagagagtgaccgggtaagtggtttggtgggaaaaatagttatggcagagcaggaaatcggaatgagtcagggtggagaatgagtcagggcagagcaggtaatcagaatgagtcagggtggagcaggtagttgaaaaagattgctttacgaggaagttaagctttttttgttttgttttgttttttttaattgagacagagtctcgctctatagcctagactggagtgcagtggcggcatctc

SEQ ID NO: 303083 - DNA, 244 bp, Homo sapiens
ctcctcctgtctgcgtattgttctgtagcaccccgtgcgcaccttgattgtagcgcttaaggtgtccgttttatttactagacagggattgaaccattgtgtcccaaccacctagaacctgggtcatagtgtaaagcttaatcaatgtaatataaatgggggaattaaattcataattgtttaatgtttaagttttgtcttaaattttaaaagtaaatgttggggatggaggggagggacagag

SEQ ID NO: 303084 - DNA, 907 bp, Homo sapiens
gaatgcttgagtagaaaggcaagggagtgaccactaagccctgttatttaaaaagaaaaaccaaacagtaaaacacacacccacacttataaaaggaaaatcacagctaacaaacgcctatttctatcctggggatgactgtcatttcctgggaggtcaattctctgagtagagggcttggtcaaatgagcaatggaaacagttggaagttgtggggaggcacaggagggttggcatctcaaaccctcatttccacccacaaggctgccttagcagtaactccagattctcatttcctgatcacggtcatgccatgctgagaatggtctcagtcaggcttctcaaacttgaagagggatccgaacctttctgggaagcctcctgcatggcaaatgttggctgccaaggcacaaagccaagcgcagtcatgtaagctcaactgaaagaccccgcaaagttagtataaggcttgtgaactgccttgaataaatataggtaacaacttcttcaaacaggcttttttgtgagtttcaatcctgcacaactcccaagacacggttcctcggctccacaactcttgataaataaaggtagcaaaaggtttctattaccatctacccaacagcatgagcatttcgcttgatgaaagacaagctgcaaactaacctggaaattcctgtccttttgcgaagacagtgggaaaactaagccaattagaaagcagattgaaagattccttacctggcccttcctggacatccctaaagcaacccttaatatgagcaaaatccccttcgaaaaatcacagtatatactatggacgcatcttctaagaggtgctgagtgggtgctgcgtgctgtggatggaaaggatggagcgccaactctctaaatacaagtcaccagg

SEQ ID NO: 303085 - DNA, 426 bp, Homo sapiens
tgttaatgccgggcacggcagcagaggaccctgtgaactgtccaacctgctgtgggaagctgccttgtgtcggttcttggtactggggtggtgggcggggtcagatggcgctgaaactgttgcttctcctgttccgcgagaaggttgcagttgcctctgaaggaactgctgttgctgtaaatgcctcttgccgccgttcctaggaacggcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaaggtaggagggcctgcacgctgcagaggcacccgcactgccgtct

SEQ ID NO: 303086 - DNA, 428 bp, Homo sapiens
ttcgcgatgcggaggacgcgggacagaggccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaagactggaccagtttgcaatgccacctggcagtgtctctacatacttcctcagggagatagcaattgaaaatgtaattgaataaataaggaaaggaactgcaaaaaaaaa

SEQ ID NO: 303087 - DNA, 2853 bp, Homo sapiens
aacacgattcctctggccaggccaaggggagggcgacactgacaggcgccccccacccaggggccgtggcgaagcaaggggccggctgctcagaaaaggataagaagtggtttctcctcccctcttcccttcctcatcctgcagcccgcgcctcccccctcgccgcgctgcgcacggatggcggcgggagccgcagagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccagtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303088 - DNA, 517 bp, Homo sapiens
cgggctgcaggaattcggcacggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttgggggaaggaaatataaaaaaaactcgtgccggtcgggccgaattcgggacgagctctgatggggatctacaagggggataacgggggggggtaaagccggctaacacaacagccattttggagcccagggagcaagggggaaatacgatttgccggccaagtattgagggaaaaaacagcccggcgcaaggggctaaaacgggggggcccggccctttggggaaaacaaggcgggggggatggtggagccccgaagtttaggac

SEQ ID NO: 303089 - DNA, 2982 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303090 - DNA, 3134 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgaggtgcggggccgggggcggctgggtcgtggggctccgcctgcgagctggctgtgtctgcggaggaggcggctggcggggtgggagcgggcggagtggggcgcgaggaggtggcggtggtggagagaagccgtcccacggagctcaggaccacgccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303091 - DNA, 3001 bp, Homo sapiens
  misc_feature (2984)..(2986): n is a, c, g, or t
  misc_feature (2988)..(2988): n is a, c, g, or t
  misc_feature (2992)..(2993): n is a, c, g, or t
  misc_feature (2996)..(2996): n is a, c, g, or t
  misc_feature (2998)..(2998): n is a, c, g, or t
  misc_feature (3001)..(3001): n is a, c, g, or t
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttggnnntncgtnnccncnagn

SEQ ID NO: 303092 - DNA, 2910 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303093 - DNA, 2956 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccacccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg
